United States Patent
Shock et al.

(10) Patent No.: US 12,312,617 B2
(45) Date of Patent: May 27, 2025

(54) CELL WALL HYDROLASES TARGETING C. ACNES

(71) Applicant: Topaz Biosciences, Inc., Emeryville, CA (US)

(72) Inventors: Jennifer Shock, San Francisco, CA (US); Maritza Miller, Oakland, CA (US); Oliver Liu, San Francisco, CA (US); Teresa Shock, San Francisco, CA (US)

(73) Assignee: Topaz Biosciences, Inc., Emeryville, CA (US)

( * ) Notice: Subject to any disclaimer, the term of this patent is extended or adjusted under 35 U.S.C. 154(b) by 0 days.

(21) Appl. No.: 18/882,341

(22) Filed: Sep. 11, 2024

(65) Prior Publication Data

US 2025/0034537 A1    Jan. 30, 2025

Related U.S. Application Data

(63) Continuation of application No. PCT/US2024/039933, filed on Jul. 26, 2024.

(60) Provisional application No. 63/529,224, filed on Jul. 27, 2023.

(51) Int. Cl.
| | |
|---|---|
| *C12N 9/00* | (2006.01) |
| *A61K 9/00* | (2006.01) |
| *A61K 38/47* | (2006.01) |
| *A61P 17/10* | (2006.01) |
| *C12N 9/24* | (2006.01) |

(52) U.S. Cl.
CPC .......... *C12N 9/2402* (2013.01); *A61K 9/0014* (2013.01); *A61K 38/47* (2013.01); *A61P 17/10* (2018.01); *C12Y 302/01017* (2013.01)

(58) Field of Classification Search
CPC ............ A61P 31/04; C12Y 304/24075; C12Y 403/01024; C12Y 302/01017; C12N 9/88
USPC .......................................................... 435/195
See application file for complete search history.

(56) References Cited

U.S. PATENT DOCUMENTS

2022/0315908 A1    10/2022    Corsini

FOREIGN PATENT DOCUMENTS

| WO | WO-2021175606 A1 | 9/2021 |
| WO | WO-2025024827 A1 | 1/2025 |

OTHER PUBLICATIONS

Kisselev L., (Structure, 2002, vol. 10: 8-9.*
Witkowski et al., (Biochemistry 38:11643-11650, 1999.*
Whisstock et al., (Quarterly Reviews of Biophysics 2003, vol. 36 (3): 307-340.*
Devos et al., (Proteins: Structure, Function and Genetics, 2000, vol. 41: 98-107.*
Murray et al., "Global burden of bacterial antimicrobial resistance in 2019: a systematic analysis" Lancet. Feb. 12, 2022; 399(10325):629-655.
Bailey et al., "The MEME Suite" Nucleic Acids Res. Jul. 1, 2015; 43(W1):W39-W49.
Bickers et al., "The burden of skin diseases: 2004: A joint project of the American Academy of Dermatology Association and the Society for Investigative Dermatology" J Am Acad Dermatol. Sep. 2006; 55(3):490-500.
Briers et al., "A standardized approach for accurate quantification of murein hydrolase activity in high-throughput assays" J Biochem Biophys Methods. Apr. 10, 2007; 70(3):531-533.
Bruggemann et al., "A Janus-Faced Bacterium: Host-Beneficial and-Detrimental Roles of Cutibacterium acnes" Front Microbiol. May 31, 2021; 12:673845. 22 pages.
Bustamante et al., "Deciphering how Cpl-7 cell wall-binding repeats recognize the bacterial peptidoglycan" Sci Rep. Nov. 28, 2017; 7(1):16494. 17 pages.
Chien et al., "Association of Systemic Antibiotic Treatment of Acne With Skin Microbiota Characteristics" JAMA Dermatol. Apr. 1, 2019; 155(4):425-434.
Dams et al., "Enzybiotics: Enzyme-Based Antibacterials as Therapeutics" Adv Exp Med Biol. (2019) 1148:233-253.
Fitz-Gibbon et al., "Propionibacterium acnes strain populations in the human skin microbiome associated with acne" J Invest Dermatol. Sep. 2013; 133(9):2152-2160.
Gallitano et al., "How Acne Bumps Cause the Blues: The Influence of Acne Vulgaris on Self-Esteem" Int J Womens Dermatol. (2017) Dec. 6, 2017; 4(1):12-17.
Gerstmans et al., "Synthetic biology of modular endolysins" Biotechnol Adv. May-Jun. 2018; 36(3):624-640.
Gutierrez et al., "Are Phage Lytic Proteins the Secret Weapon To Kill Staphylococcus aureus?" mBio. Jan. 2018; 9(1):e01923-17. 17 pages.
Invitation to pay additional fees for International Application No. PCT/US2024/039933, mailed Oct. 7, 2024, 3 pages.
Jin et al., "Roles of bacteriophage GVE2 endolysin in host lysis at high temperatures" Microbiology (Reading). Aug. 2013; 159(Pt 8):1597-1605.
Liu et al., "The diversity and host interactions of Propionibacterium acnes bacteriophages on human skin" ISME J. Sep. 2015; 9(9):2078-2093.

(Continued)

*Primary Examiner* — Robert B Mondesi
*Assistant Examiner* — Mohammad Y Meah
(74) *Attorney, Agent, or Firm* — Cooley LLP

(57) ABSTRACT

The present disclosure relates to novel cell wall binding domains, enzymatically active domains, and chimeric cell wall hydrolases with anti-*Cutibacterium acnes* activity. The disclosure also relates to compositions comprising these, and uses thereof in the treatment of conditions associated with *Cutibacterium acnes*.

25 Claims, 55 Drawing Sheets

Specification includes a Sequence Listing.

(56) References Cited

OTHER PUBLICATIONS

Lomholt et al., "A comparative study of Cutibacterium (Propionibacterium) acnes clones from acne patients and healthy controls" Anaerobe. Oct. 2017; 47:57-63.

Madeira et al., "The EMBL-EBI Job Dispatcher sequence analysis tools framework in 2024" Nucleic Acids Res. Jul. 5, 2024; 52(W1):W521-W525.

Marinelli et al., "Propionibacterium acnes bacteriophages display limited genetic diversity and broad killing activity against bacterial skin isolates" mBio. Sep. 25, 2012; 3(5):e00279-12. 13 pages.

Matsuzaki et al., "Bacteriophage therapy: a revitalized therapy against bacterial infectious diseases" Journal of Infection and Chemotherapy. (2005) 11:211-219.

Mayer et al., "Molecular characterization of a Clostridium difficile bacteriophage and its cloned biologically active endolysin" J Bacteriol. Oct. 2008; 190(20):6734-6740.

Mias et al., "Recent advances in understanding inflammatory acne: Deciphering the relationship between Cutibacterium acnes and Th17 inflammatory pathway" J Eur Acad Dermatol Venereol. Mar. 2023: 37 (Suppl 2):3-11.

Natarelli et al., "Bacteriophages and the Microbiome in Dermatology: The Role of the Phageome and a Potential Therapeutic Strategy" Int J Mol Sci. Jan. 31, 2023; 24(3):2695. 11 pages.

NCBI Accession ID: YP_006907103.1, Jan. 8, 2023, 2 pages.

Oliveira et al., "Staphylococci phages display vast genomic diversity and evolutionary relationships" BMC Genomics. May 9, 2019; 20(1):357. 14 pages.

Patangia et al., "Impact of antibiotics on the human microbiome and consequences for host health" Microbiologyopen. Feb. 2022; 11(1):e1260. 23 pages.

Varotsou et al., "Characterization and Engineering Studies of a New Endolysin from the Propionibacterium acnes Bacteriophage PAC1 for the Development of a Broad-Spectrum Artilysin with Altered Specificity" Int J Mol Sci. May 10, 2023; 24(10):8523. 19 pages.

Vermassen et al., "Cell wall hydrolases in bacteria: insight on the diversity of cell wall amidases, glycosidases and peptidases toward peptidoglycan" Frontiers in Microbiology. (2019) 10:331. 27 pages.

Wang et al., "Protein domain identification methods and online resources," Comput Struct Biotechnol J (2021)19:1145-1153.

Zaenglein et al., "Guidelines of care for the management of acne vulgaris" J Am Acad Dermatol. (2016) May 74(5):945-973.e33.

Zhang et al., "Antimicrobial Susceptibility, Biotypes and Phylotypes of Clinical Cutibacterium (Formerly Propionibacterium) acnes Strains Isolated from Acne Patients: An Observational Study" Dermatol Ther (Heidelb). Dec. 2019; 9(4):735-746.

International Search Report and Written Opinion for PCT Application No. PCT/US2024/039933 mailed Dec. 11, 2024, 17 pages.

UniProtKB Accession No. A0A2W5K6W6, N-acetylmuramoyl-L-alanine amidase. Sep. 12, 2018 [online]. [Retrieved on Nov. 27, 2024]. Retrieved from the internet: URL: [https://www.uniprot.org/uniprotkb/A0A2W5K6W6/entry], 6 pages.

UniProtKB Accession No. A0A3E2DMAO, N-acetylmuramoyl-L-alanine amidase. Jan. 16, 2019 [online]. [Retrieved on Nov. 27, 2024]. Retrieved from the internet: URL: [https://www.uniprot.org/uniprotkb/A0A3E2DMA0/entry], 4 pages.

\* cited by examiner

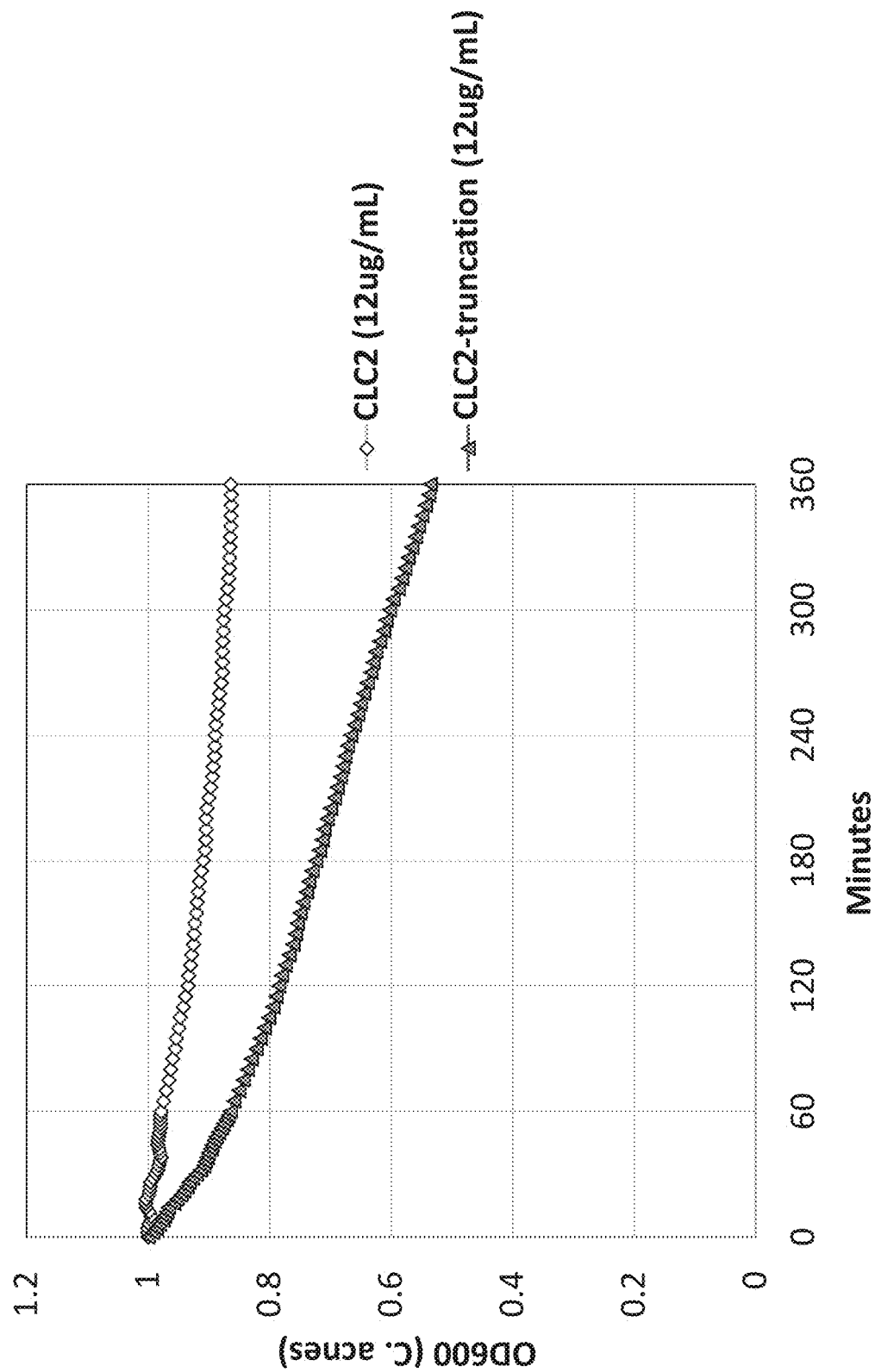

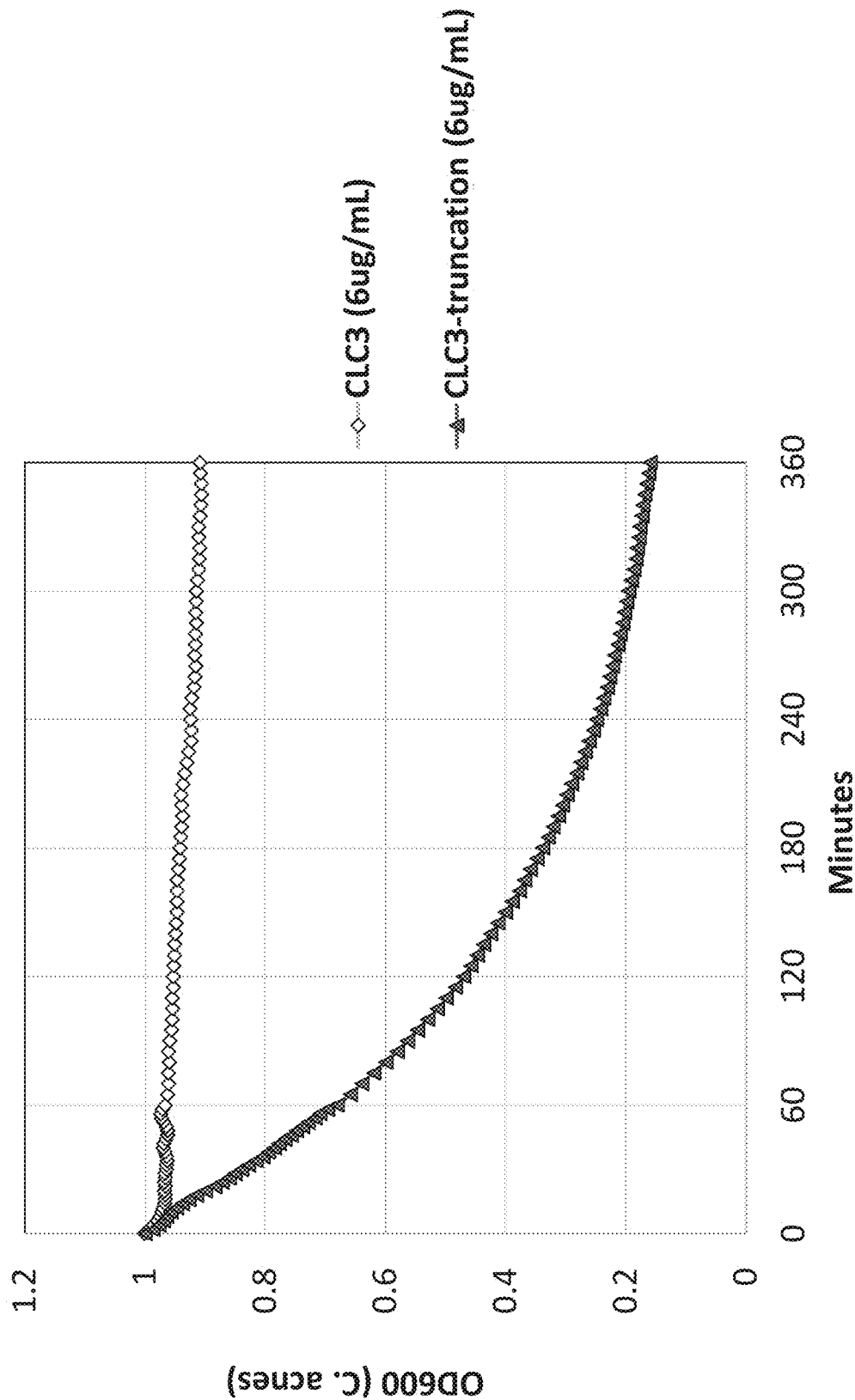

FIG. 8A

Source of EAD: CD27L
Native target: *Clostridium difficile*

- CD27L-EAD + CLB1-CBD (12ug/mL)
- CD27L-EAD + CLB2-CBD (12ug/mL)
- Native CD27L (48ug/mL)

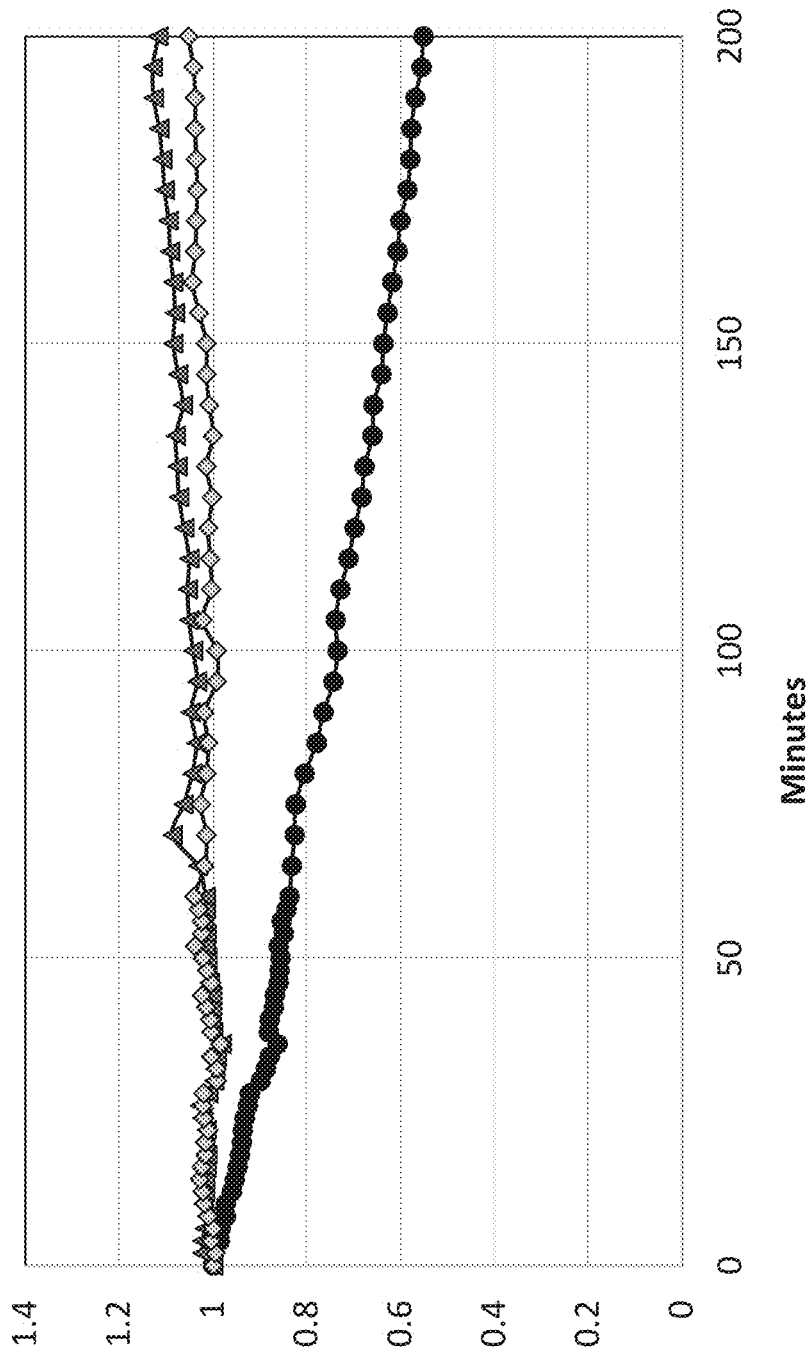

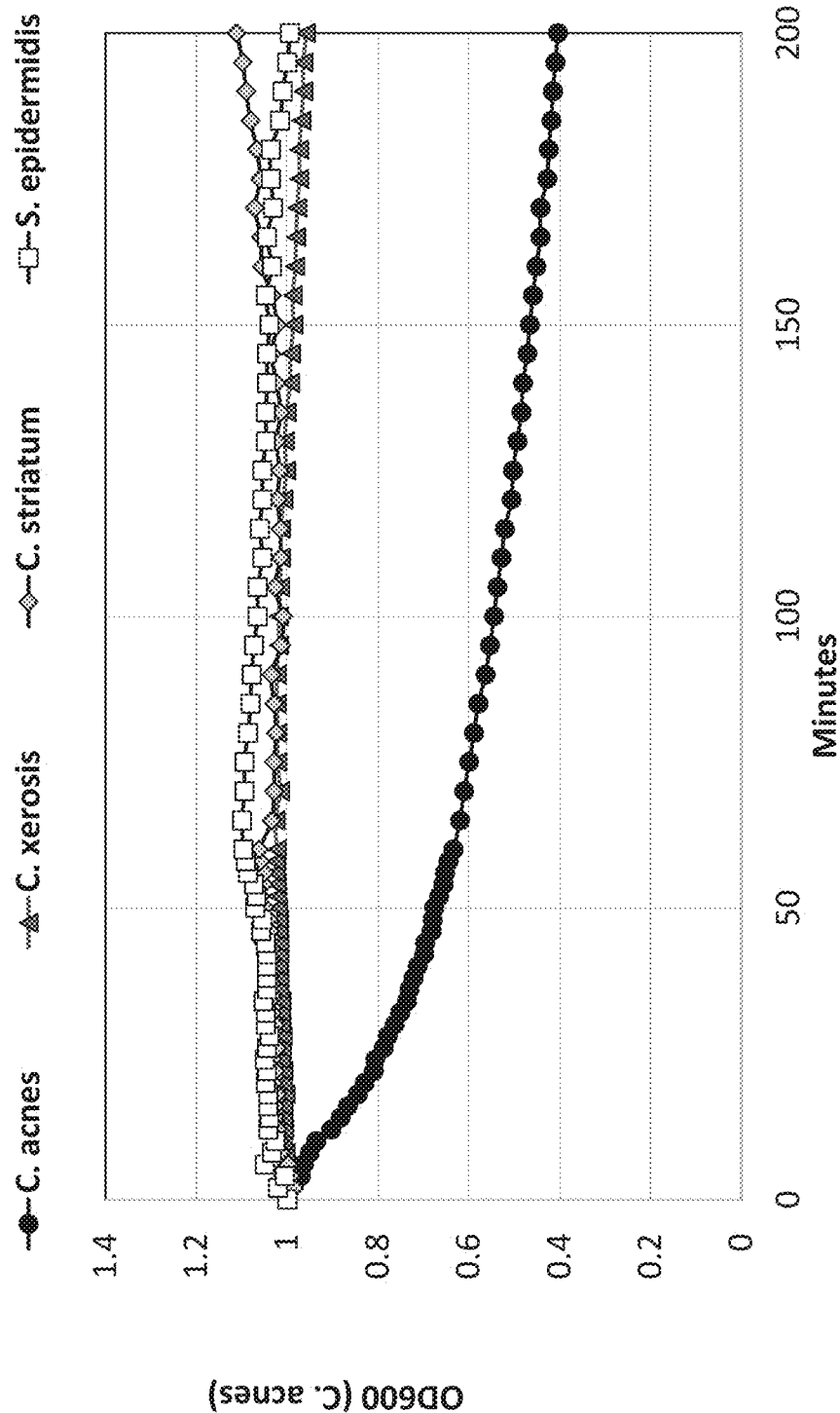

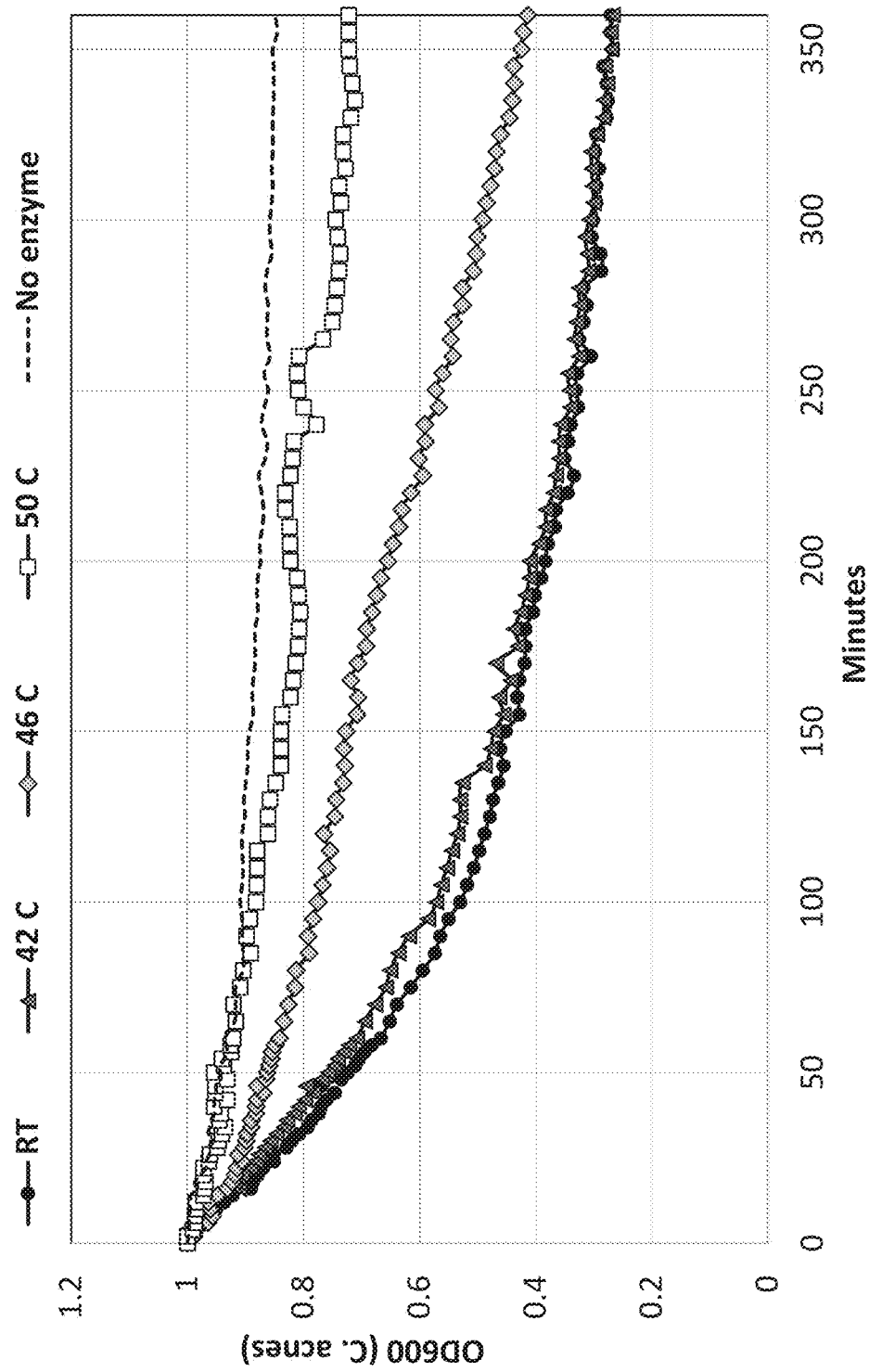

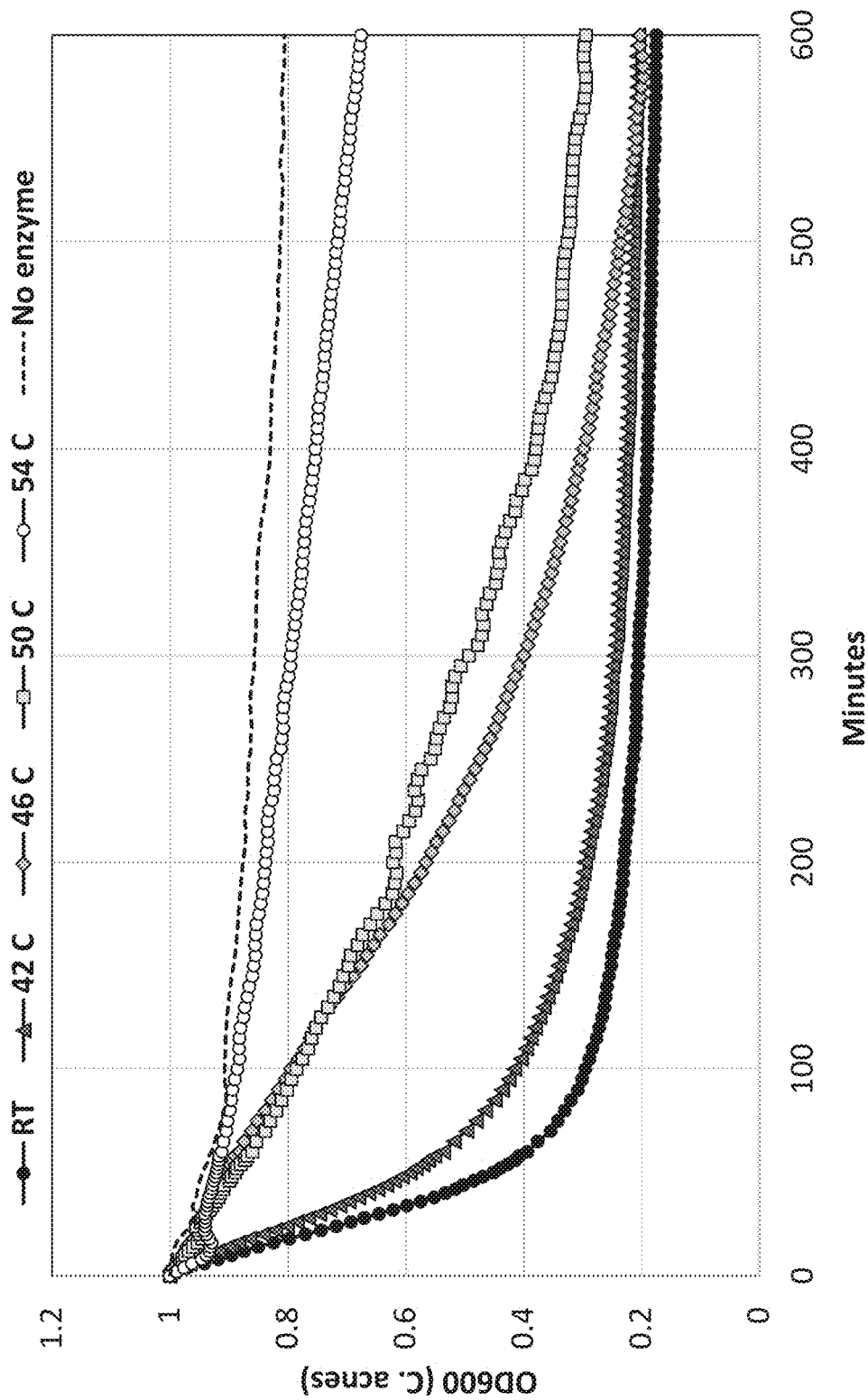

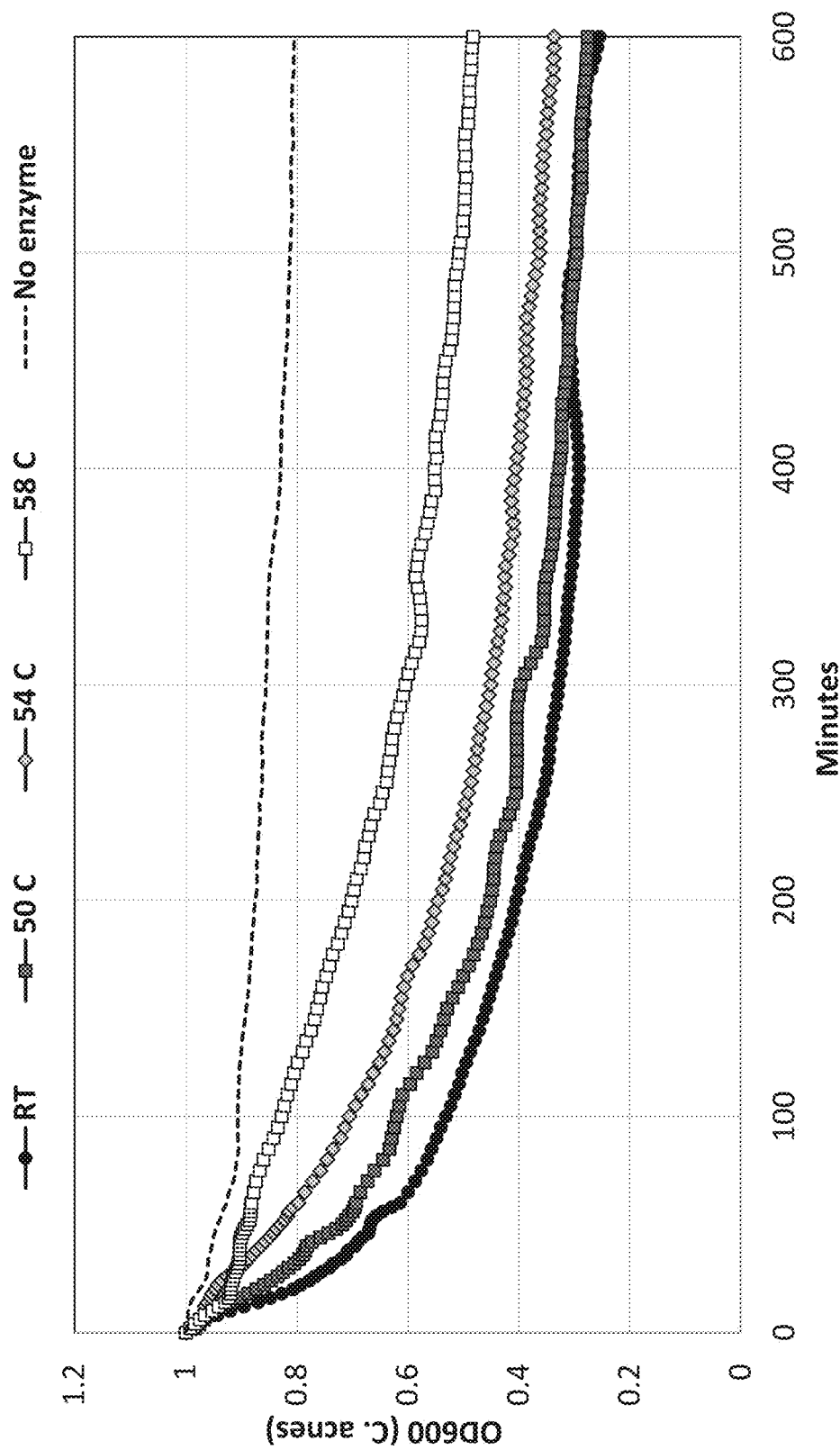

FIG. 17

| | CLC1-EAD | CLC5-EAD | CLC4-EAD | CLC8-EAD | CLC3-EAD | CLC10-EAD | CLC2-EAD | CLC14-EAD | CLC16-EAD |
|---|---|---|---|---|---|---|---|---|---|
| CLC1-EAD | 100 | 96.27 | 95.65 | 90.68 | 88.2 | 88.2 | 88.82 | 80.12 | 78.26 |
| CLC5-EAD | 96.27 | 100 | 94.41 | 88.82 | 86.96 | 88.2 | 86.34 | 79.5 | 79.5 |
| CLC4-EAD | 95.65 | 94.41 | 100 | 90.68 | 89.44 | 85.71 | 86.96 | 78.26 | 77.02 |
| CLC8-EAD | 90.68 | 88.82 | 90.68 | 100 | 92.55 | 85.71 | 84.47 | 80.12 | 78.26 |
| CLC3-EAD | 88.2 | 86.96 | 89.44 | 92.55 | 100 | 81.99 | 84.47 | 81.37 | 79.5 |
| CLC10-EAD | 88.2 | 88.2 | 85.71 | 85.71 | 81.99 | 100 | 81.99 | 79.5 | 77.64 |
| CLC2-EAD | 88.82 | 86.34 | 86.96 | 84.47 | 84.47 | 81.99 | 100 | 83.85 | 78.26 |
| CLC14-EAD | 80.12 | 79.5 | 78.26 | 80.12 | 81.37 | 79.5 | 83.85 | 100 | 79.5 |
| CLC16-EAD | 78.26 | 79.5 | 77.02 | 78.26 | 79.5 | 77.64 | 78.26 | 79.5 | 100 |

CLC14-EAD + CLB2-CBD

CLC16-EAD + CLB2-CBD

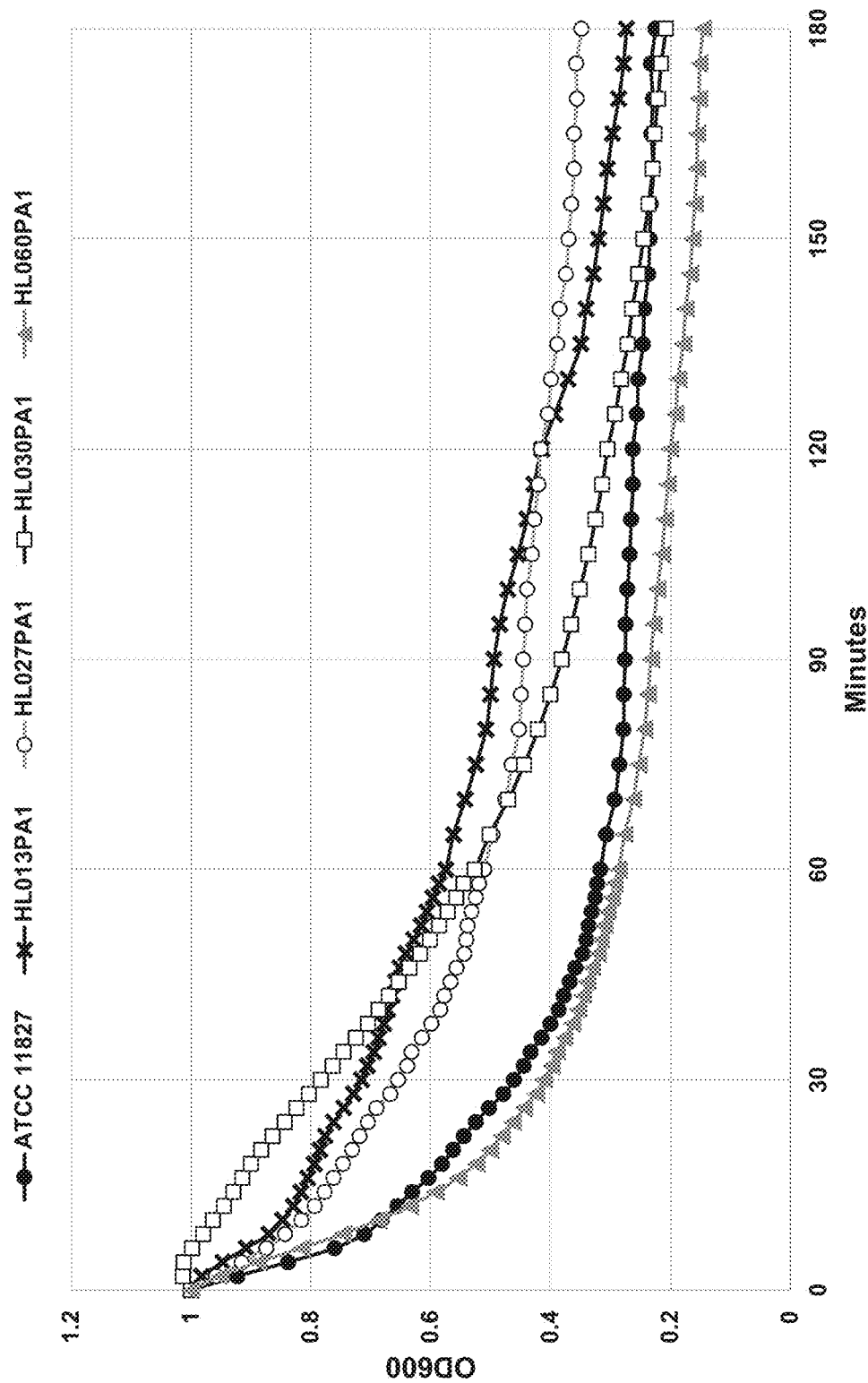

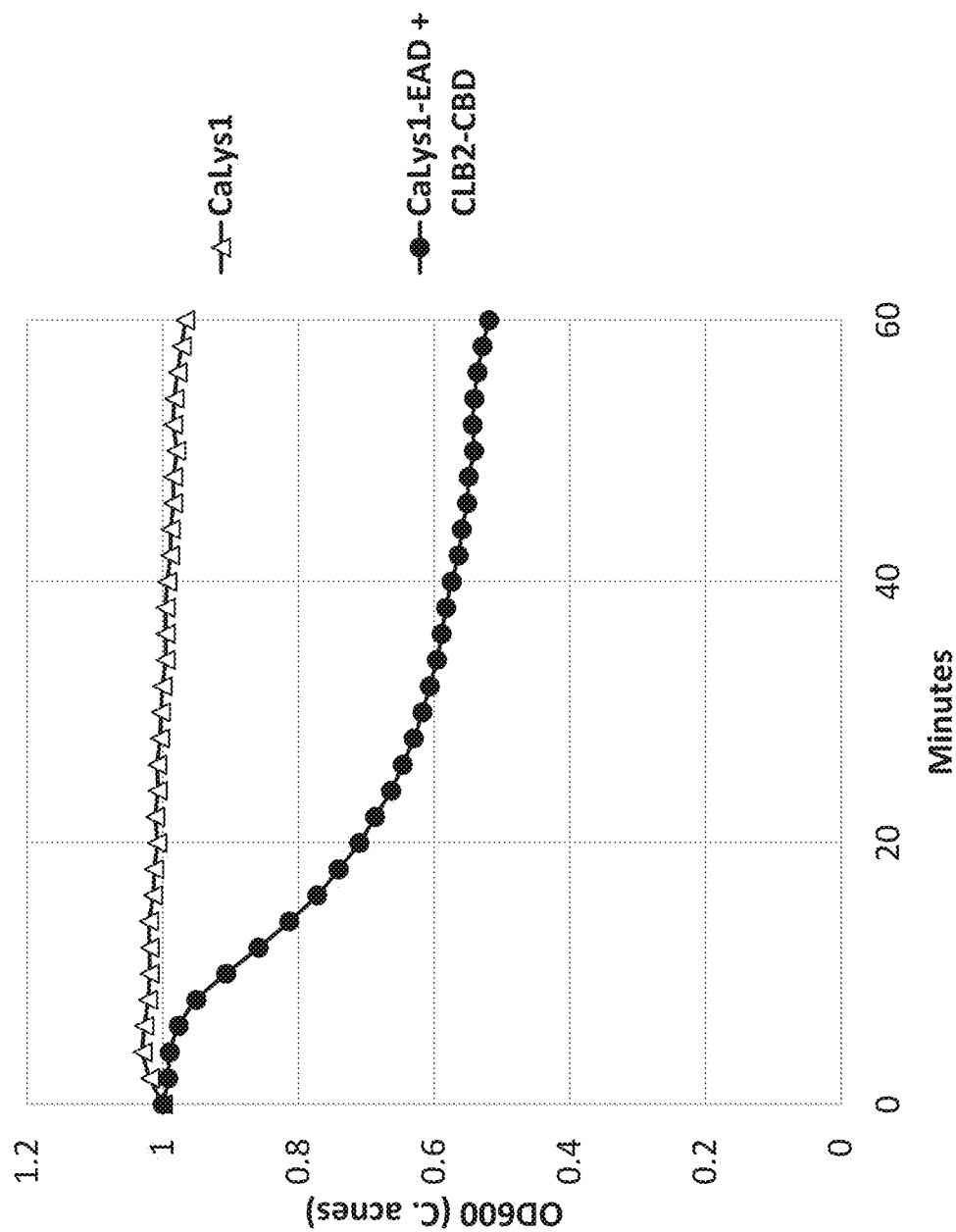

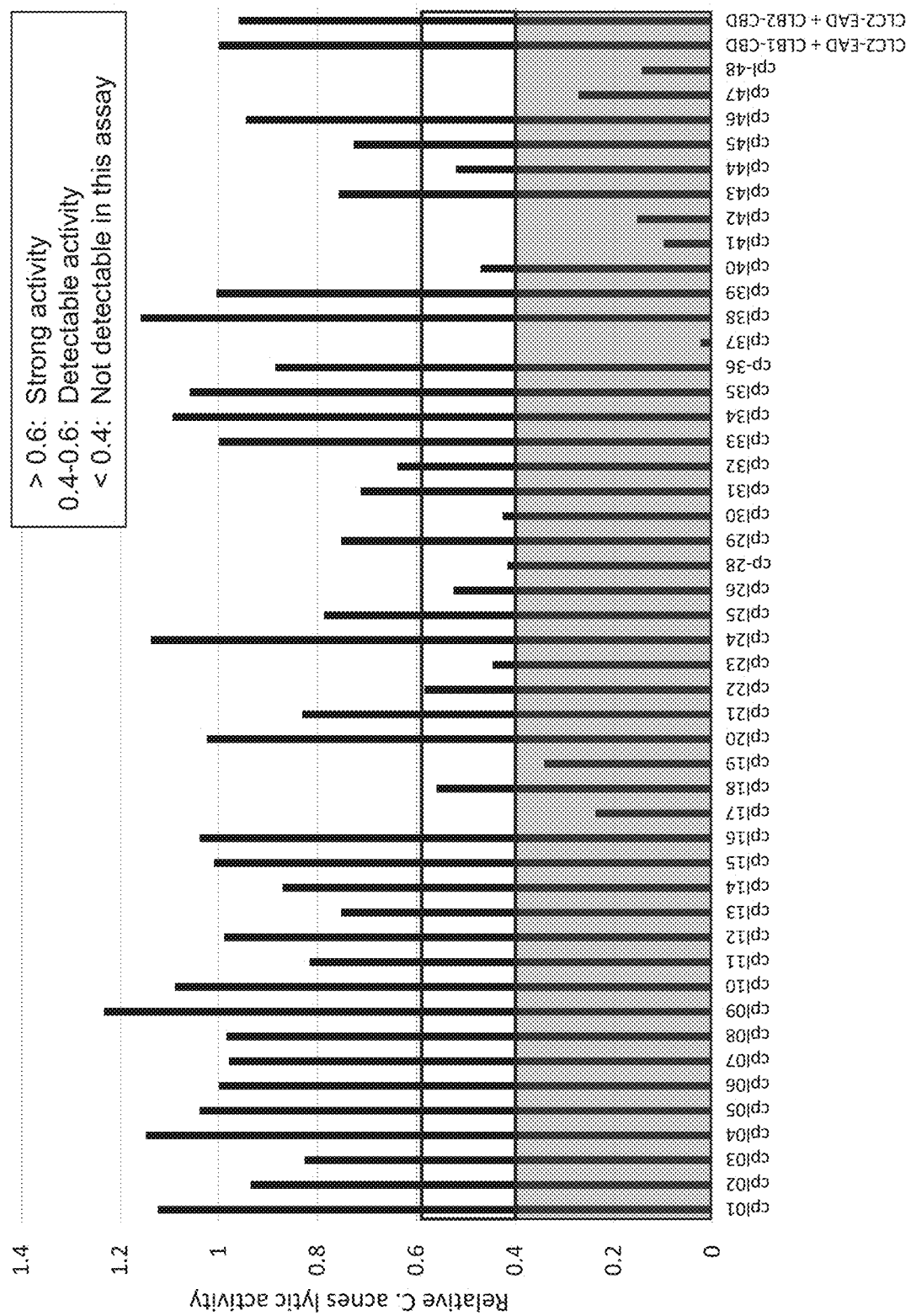

Motif 1:
YXXXQWLSXXVWX
PAVERAAXLARXXC
ICXRXXIPXRXL
XXXXXVXGXGI
XG

Motif 2:
RXXSAHYXXDXXXG
XTXQCLXEXXGI
XHAPPNXXSIGXS
EICXXGGSXXF

Motif 3:
RXVIHXTCPDXG
XPXASXAGRAXS
TAXYF

Motif 4:
VSXAFXXSDHDD
PG

Motif 5:
NXPV/IT/S

CELL WALL HYDROLASES TARGETING C. ACNES

CROSS-REFERENCE TO RELATED APPLICATIONS

This application is a continuation of International Application PCT/US2024/039933, filed Jul. 26, 2024, which claims the benefit of and priority to U.S. Provisional Patent Application No. 63/529,224, filed on Jul. 27, 2023, the contents of which are herein incorporated by reference in their entirety.

STATEMENT REGARDING FEDERALLY SPONSORED RESEARCH

This invention was made with government support under R43 AR082722 awarded by the National Institutes of Health. The government has certain rights in the invention.

REFERENCE TO AN ELECTRONIC SEQUENCE LISTING

The contents of the electronic sequence listing (TOPB_003_01WO_SeqList_ST26.xml; Size: 3,993,956 bytes; and Date of Creation: Jul. 26, 2024) are herein incorporated by reference in their entirety.

FIELD OF THE DISCLOSURE

The present disclosure relates to novel enzymatically active domains, cell wall binding domains, and cell wall hydrolases with activity against *Cutibacterium acnes*. The disclosure also relates to compositions comprising these recombinant domains and proteins, and methods of treating conditions associated with *Cutibacterium acnes*.

BACKGROUND

Acne vulgaris (acne) is a chronic inflammatory disease of the pilosebaceous unit, affecting up to 50 million people in the U.S. annually. Acne can have significant negative effects on psychosocial functioning including higher rates of anxiety, low self-esteem, depression, failure to thrive at school, and suicidal ideation. *Cutibacterium acnes* (previously known as *Propionibacterium acnes*), an anaerobic, gram-positive bacterium, plays a prominent role in acne pathogenesis. *C. acnes* is the most common species in the pilosebaceous unit, and contrary to previous models that linked acne with *C. acnes* proliferation, metagenomic analyses now indicate that the relative abundance of *C. acnes* is similar between healthy and acneic skin. Instead, acne development is now understood to be associated with a loss of *C. acnes* phylotype diversity. *C. acnes* strains are classified into six main phylotypes: $IA_1$, $IA_2$, IB, IC, II and III based on their genomic sequences. Numerous studies have linked acne to higher relative abundances of phylotype $IA_1$. It is believed that it is specifically decreases in non-phylotype $IA_1$ strains that triggers innate immune stimulation and acne pathogenesis. Antibiotics continue to play a central role in the treatment of acne. First-line combination treatments include topical antibiotics for mild to moderate acne and systemic oral antibiotics for moderate to severe acne. While effective, high levels of antibiotic use, particularly systemic oral antibiotics, pose challenges. First, there may be unintended negative effects on the gut and skin microbiomes, including changes in microbial composition, reduced microbial diversity, and changes in functional attributes. Second, overuse of antibiotics promotes antimicrobial resistance, a pressing public health threat. As such, there is a strong need for novel antimicrobial agents that can target *C. acnes* and provide a microbiome-friendly alternative to standard antibiotics.

Endolysins are phage-encoded bacterial cell wall-degrading enzymes that catalyze rapid and selective killing of bacteria in the skin microbiome. Endolysins are normally expressed late in the phage lytic cycle. The endolysin binds and rapidly degrades the host bacterium cell wall, causing the cell to burst, freeing the mature viral particles. Endolysins can lyse their cognate bacteria, even within biofilms, and bacteria are difficult to evolve resistance to endolysins due to the difficulty of changing their peptidoglycan without deleterious effects. However, all prior attempts to develop endolysins targeting *C. acnes* have faced significant challenges.

First, the diversity of known *C. acnes* phages/endolysins is extremely low. Comprehensive efforts to isolate and sequence *C. acnes* phage diversity have found that all isolated *C. acnes* phages thus far are highly similar to each other, with little variation in gene content from genome to genome. The nucleotide sequence identity between any pair of *C. acnes* phage genomes ranges from 85-100% (Liu et al., ISME J. 2015 September; 9(9): 2078-2093; Marinelli et al., mBio. 2012 September-October; 3(5): e00279-12). These genomes contain only a single highly-conserved endolysin (as exemplified by the protein sequence with NCBI accession ID: YP_006907103.1, which is referred to as "CaLys1" hereinafter) greatly limiting the amount of natural diversity that can be leveraged for endolysin development. In contrast, endolysins that target *Staphylococcus* sp. can be divided into at least 27 sub-groups (Oliveira et al., BMC Genomics. 2019 May 9; 20(1):357).

The second challenge is that attempts to characterize CaLys1 and close homologs from *C. acnes* phages have encountered issues with low solubility and low activity. Multiple groups have attempted to recombinantly express CaLys1 and close homologs and found the protein to be insoluble. Labor-intensive methods such as the use of urea gradients are needed to resolubilize the protein, an approach that is not commercially viable. In addition, this endolysin has exhibited low activity with activity assays utilizing high concentrations of protein (e.g. 100 mg/mL) (see, e.g., WO 2021/175606; Varotsou et al., Int J Mol Sci. 2023 May 10; 24(10):8523).

Thus, there is a strong unmet need for new endolysins (and bacterial cell wall hydrolases more generally) that can selectively target *C. acnes* with improved characteristics compared to the currently known CaLys1 family.

BRIEF SUMMARY

The present disclosure teaches chimeric cell wall hydrolases (CWH) with desirable properties. In some embodiments, the CWHs of the present disclosure are capable of selectively treating conditions associated with *Cutibacterium acnes*.

In one aspect, the present disclosure provides a chimeric cell wall hydrolase (CWH) comprising: a CW_7 cell wall binding domain (CBD), and a CLC1-family enzymatically active domain (EAD).

In another aspect, the present disclosure provides a chimeric cell wall hydrolase (CWH) comprising:
a. a cell wall binding domain (CBD) comprising a CW_7 amino acid sequence having at least 40, 45, 50, 55, 60, 65, 70, 75, 80, 85, 90, 95, 96, 97, 98, or 99% sequence identity to, or having the sequence of:
  i. SEQ ID NO: 47;
  ii. an amino acid sequence selected from the group consisting of SEQ ID NO: 45, 46, 48, 49, 50, and 51;
  iii. a CW_7 sequence comprised by an amino acid sequence selected from the group consisting of SEQ ID NO: 166-223;
  iv. a CW_7 sequence comprised by an amino acid sequence selected from the group consisting of SEQ ID NO: 282-2938; or
  v. a CW_7 sequence comprised by an amino acid sequence selected from Table 7; and
b. an enzymatically active domain (EAD) comprising an amino acid sequence having at least 40, 45, 50, 55, 60, 65, 70, 75, 80, 85, 90, 95, 96, 97, 98, or 99% sequence identity to, or having the sequence of:
  i. SEQ ID NO: 35;
  ii. SEQ ID NO: 21;
  iii SEQ ID NO: 73;
  iv. an amino acid sequence selected from the group consisting of SEQ ID NO: 20-36;
  v. an EAD derived from SEQ ID NO: 1-19;
  vi. an EAD derived from CLC16, CLC2, CLC1, CLC3, CLC4, CLC5, CLC6, CLC7, CLC8, CLC9, CLC10, CLC11, CLC12, CLC13, CLC14, CLC15, CLC17, CLC18, or CLC19;
  vii. SEQ ID NO: 64; or
  viii. SEQ ID NO: 63.

In another aspect, the present disclosure provides a recombinant protein comprising a CLC1-family enzymatically active domain (EAD).

In another aspect, the present disclosure provides a recombinant protein comprising a CW_7 cell wall binding domain (CBD).

In another aspect, the present disclosure provides an enzymatically active, C-terminally truncated recombinant CLC1-family protein or CaLys1 protein.

In another aspect, the present disclosure provides a formulation comprising a chimeric CWH, recombinant protein, or truncated protein of any one of the foregoing embodiments, optionally wherein the formulation is a topical formulation.

In another aspect, the present disclosure provides a method of treating a condition associated with *Cutibacterium acnes* (*C. acnes*), the method comprising: administering a composition comprising a recombinant protein, chimeric CWH, or truncated protein of any one of the foregoing embodiments or a formulation of any one of the foregoing embodiments.

In another aspect, the present disclosure provides a method of restoring the phylotype diversity of *Cutibacterium acnes*, the method comprising: administering a composition comprising a recombinant protein, chimeric CWH, or truncated protein of any one of the foregoing embodiments or a formulation of any one of the foregoing embodiments.

In another aspect, the present disclosure also provides a method of identifying a novel CW_7 cell wall binding domain for use in binding, targeting and/or lysing *Cutibacterium acnes*, the method comprising the steps of:
  a. Searching a genetic database with a known CW_7 query sequence;
  b. Identifying sequences exceeding an amino acid sequence identity cutoff to the query sequence;
  c. Cloning the CW_7 sequence, or the CW_7-comprising CBD sequence, into a chimeric cell wall hydrolase in combination with an enzymatically active domain (EAD) to form a CW_7 chimera; and
  d. Assaying the CW_7 chimera for binding, targeting, and/or lytic activity against *Cutibacterium acnes*.

BRIEF DESCRIPTION OF THE SEVERAL VIEWS OF THE DRAWINGS

The accompanying figures, which are incorporated herein and form a part of the specification, illustrate some, but not the only or exclusive, example embodiments and/or features. It is intended that the embodiments and figures disclosed herein are to be considered illustrative rather than limiting.

FIG. 5A-5D show the results of turbidity reduction assays against *C. acnes* comparing C-terminal truncations to full-length native CLC1-family proteins and CaLys1. Results correspond to CLC2 (FIG. 5A), CLC3 (FIG. 5B), CLC16 (FIG. 5C) and CaLys1 (FIG. 5D)

FIG. 8A-8B show lytic activity assay results demonstrating that CLB1-CBD and CLB2-CBD can be used to create chimeric endolysins that target *C. acnes*. Results are shown for CLB1-CBD and CLB2-CBD in combination with an EAD from a protein that targets *Clostridium dificile* (CD27L) (FIG. 8A) and in combination with an EAD from a protein that targets *Geobacillus* sp. (PlyGVE2) (FIG. 8B).

FIG. 13A-13D show results of turbidity reduction assays, demonstrating selectivity for *C. acnes* over commensal skin bacteria from other genera for four chimeric proteins of the disclosure: CLC1-EAD+CLB1-CBD (FIG. 13A); CLC1-EAD+CLB2-CBD (FIG. 13B); CLC3-EAD+CLB1-CBD (FIG. 13C); and CLC3-EAD+CLB2-CBD (FIG. 13D).

FIG. 14A-14D show results of thermostability assays on four chimeric proteins of the disclosure: CLC1-EAD+CLB1-CBD (FIG. 14A); CLC1-EAD+CLB2-CBD (FIG. 14B); CLC3-EAD+CLB1-CBD (FIG. 14C); and CLC3-EAD+CLB2-CBD (FIG. 14D).

FIG. 17 shows the percent amino acid sequence identity among the EADs from CLC1, CLC5, CLC4, CLC8, CLC3, CLC10, CLC2, CLC14, and CLC16.

FIG. 20A-20D show the results of turbidity reduction assays against different strains and phyla of *C. acnes* for two chimeras of the disclosure. FIG. 20A shows results for the CLC1-EAD+CLB2-CBD chimera against strains ATCC 11827, HL013PA1, HL027PA1, HL030PA1, and HL060PA1. FIG. 20B shows results for the CLC1-EAD+CLB2-CBD chimera against strains ATCC 11827, HL001PA1, and HL056PA1. FIG. 20C shows results for the CLC16-EAD+CLB2-CBD chimera against strains ATCC 11827, HL013PA1, HL027PA1, HL030PA1, and HL060PA1. FIG. 20D shows results for the CLC16-EAD+CLB2-CBD chimera against strains ATCC 11827, HL001PA1, and HL056PA1.

FIG. 21A-21C show the results of turbidity reduction assays for full-length CaLys1 and the CaLys1-EAD+CLB2-CBD chimeric protein against *C. acnes* (FIG. 21A), *C. striatum* (FIG. 21B), and *S. aureus* (FIG. 21C).

FIG. 23A shows the result of whole cell lysate screening of diverse CW_7 CBD comprising chimeras in a turbidity reduction assay.

DETAILED DESCRIPTION

Figure 1A:
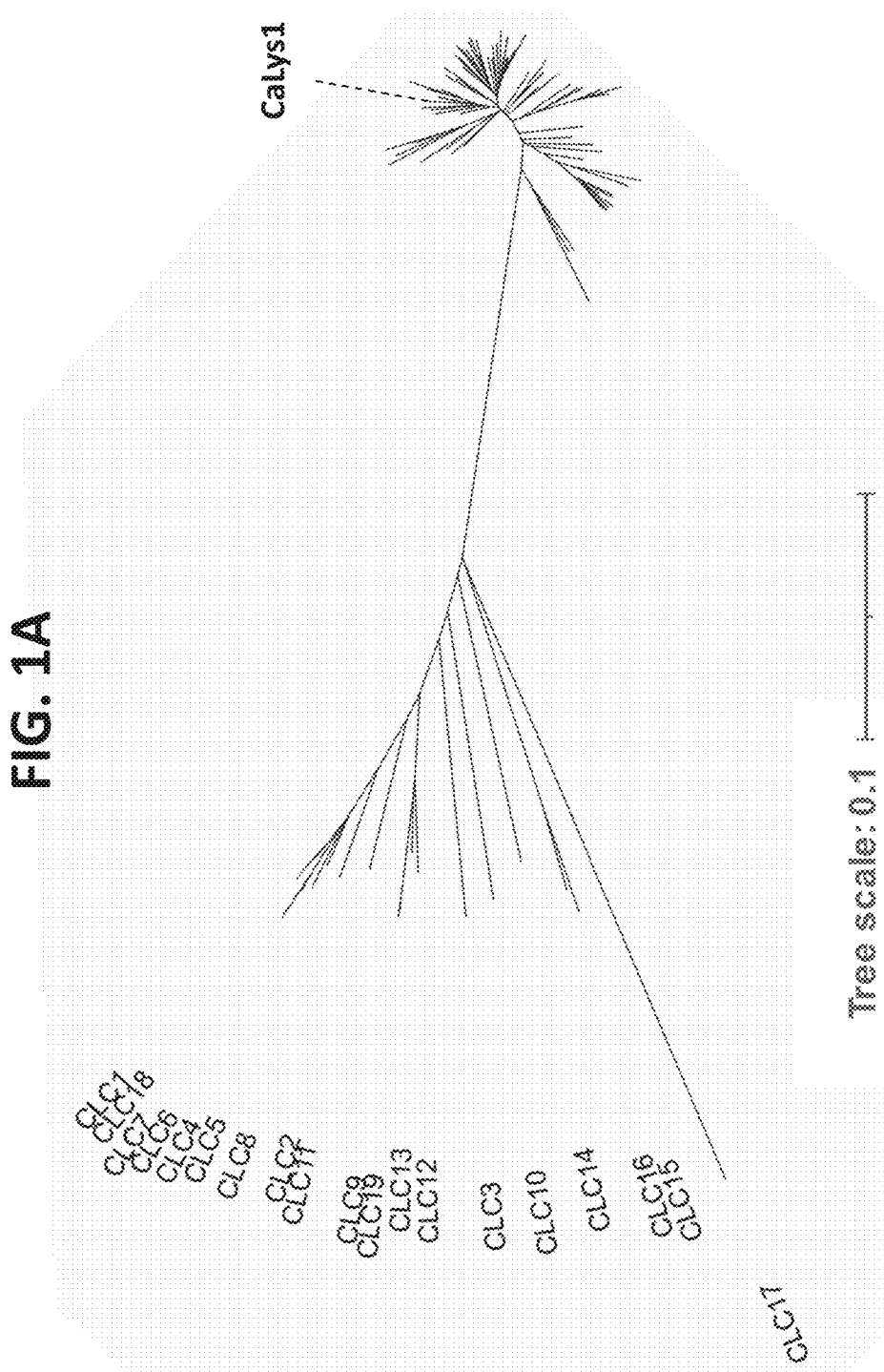
FIG. 1A shows a phylogenetic tree containing CLC1-CLC19 as well as endolysins found in the genomes of *C. acnes* strains/phages including CaLys1. The CLC1 family of proteins form a distinct grouping separate from the CaLys1 family of endolysins.

All publications, patents and patent applications, including any drawings and appendices, are herein incorporated by reference to the same extent as if each individual publication or patent application was specifically and individually indicated to be incorporated by reference.

The following description includes information that may be useful in understanding the present disclosure. It is not an admission that any of the information provided herein is prior art, or that any publication specifically or implicitly referenced is prior art.

Definitions

The term "a" or "an" refers to one or more of that entity, i.e. can refer to plural referents. As such, the terms "a," "an," "one or more," and "at least one" are used interchangeably herein. In addition, reference to "an element" by the indefinite article "a" or "an" does not exclude the possibility that more than one of the elements is present, unless the context clearly requires that there is one and only one of the elements.

Throughout this application, the term "about" is used to indicate that a value includes the inherent variation of error for the device or the method being employed to determine the value, or the variation that exists among the samples being measured. Unless otherwise stated or otherwise evident from the context, the term "about" means within 10% above or below the reported numerical value (except where such number would exceed 100% of a possible value or go below 0%). When used in conjunction with a range or series of values, the term "about" applies to the endpoints of the range or each of the values enumerated in the series, unless otherwise indicated. As used in this application, the terms "about" and "approximately" are used as equivalents.

Unless otherwise indicated, it is to be understood that all numbers expressing quantities, ratios, and numerical properties of ingredients, reaction conditions, and so forth, used in the specification and claims are contemplated to be able to be modified in all instances by the term "about".

As used herein, the term "cell wall hydrolase" or "CWH" refers to bacterial cell wall hydrolases, which are enzymes that degrade peptidoglycan in bacterial cell walls by cleaving bonds in the peptidoglycan chain and side-chain branches. Cell wall hydrolases may have different domain architectures. CWHs comprise an "enzymatically active domain" or "EAD," which is a domain responsible for degrading peptidoglycan. In some embodiments, the EAD has glycosidase, amidase, and/or peptidase enzymatic activity. In some embodiments, CWHs comprise a "cell wall binding domain" or "CBD", which is a domain that binds to a bacterial cell wall.

A "native" protein is used to indicate a protein that occurs in nature and has not been artificially modified or recombined.

The term "recombinant" is used herein to describe nucleic acids, proteins, vectors, and host cells which do not occur in nature or, in the context of nucleic acids, are in an arrangement not found in nature. A "recombinant protein" therefore refers to a protein which does not occur in nature. In some embodiments, recombinant protein, as used herein, refers to a chimeric protein. In some embodiments, recombinant protein refers to the expression product of any of the presently disclosed EAD or CBD sequences alone, or within a protein that does not occur in nature. For example, the present disclosure envisions recombinant EAD or CBD sequences of the disclosure fused to any protein tags, such as 6×His.

As used herein, "heterologous" refers to any genetic material that is artificially introduced into a non-native context. E.g., a heterologous domain refers to a domain, such as an EAD or CBD, that is artificially introduced into a recombinant protein sequence, wherein the resulting recombinant protein sequence is non-native. Two polypeptide sequences or domains are heterologous to one another if they are derived from different native polypeptide sequences or proteins. For example, in some embodiments, a CBD and an EAD are heterologous to each other if they are derived from different native proteins.

As used herein, a "chimeric protein" is any recombinant protein comprising two or more heterologous domains, e.g., EADs and/or CBDs.

As used herein, a "domain" of a protein is a functional and/or structural subunit in a protein. In some embodiments, they are responsible for a particular function or interaction, contributing to the overall role of a protein. Protein domains are fundamental units of protein structure, folding, function, evolution and design. See, e.g., Wang et al., "Protein domain identification methods and online resources," *Comput Struct Biotechnol J* 2021; 19:1145-1153, incorporated by reference herein.

As used herein, a "chimeric cell wall hydrolase" or "chimeric CWH" is a chimeric protein that acts as a cell wall hydrolase and comprises at least one heterologous domain, e.g., a heterologous EAD or CBD, compared to a native CWH sequence. In some embodiments, a chimeric CWH refers herein to a recombinant protein comprising two heterologous CWH domains, e.g., an EAD and a CBD.

As used herein, "activity" refers to the ability of a chimeric protein to inhibit the growth of and/or lyse a cell from a *Cutibacterium acnes* species. The term "active against", as used herein with reference to a target species of *Cutibacterium acnes*, refers to a chimeric protein, e.g., a CWH, of the disclosure that is able to inhibit the growth of and/or lyse cells belonging to that target species of *Cutibacterium acnes*. Activity can be calculated in different ways, depending on the assay performed. In some embodiments, level of activity is indicated based on minimum inhibitory concentration ("MIC"), e.g., the minimum concentration of the protein required to prevent growth of the target *Cutibacterium acnes* species in an MIC assay. In some embodiments, level of activity is indicated based on turbidity reduction, e.g., with activity calculated as $-\Delta OD_{600}/min/(mg$ of enzyme). In some embodiments, activity is indicated based on the decrease in viable bacterial cells in a culture after a period of incubation (e.g., 2 hours) with a protein.

In the context of anti-*Cutibacterium acnes* activity, the terms "selective" and "selectivity" as used herein refer to the property of showing higher activity toward one target species of *Cutibacterium acnes* in comparison to a second species of *Cutibacterium acnes*. Selectivity can be calculated by comparing the inverse of the MIC of a chimeric protein toward a first species to the MIC of the protein toward a second species. In some embodiments, selectivity is determined based on relative activity in a turbidity reduction assay.

As used herein the term "sequence identity" refers to the extent to which two optimally aligned polynucleotides or polypeptide sequences are invariant throughout a window of alignment of residues, e.g. nucleotides or amino acids. An "identity fraction" for aligned segments of a test sequence and a reference sequence is the number of identical residues which are shared by the two aligned sequences divided by the total number of residues in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as, for example, those in the BLAST suite of sequence analysis programs. Unless noted otherwise, the term "sequence identity" in the claims refers to sequence identity as calculated by MUSCLE (www.ebi.ac.uk/Tools/msa/muscle/) using default parameters.

As used herein, the term "CW_7 cell wall binding domain" or "CW_7 CBD" refers to a cell wall binding domain containing one or more CW_7 sequences. In some embodiments, a CW_7 CBD comprises, consists essentially of, or consists of a CW_7 sequence.

The term "including all ranges and subranges therebetween" or equivalents, are used herein to denote the intention that disclosure of any range or series of possible values, inherently also discloses all ranges and subranges encompassed by the highest and lowest values disclosed. This term includes the entire range from highest to lowest disclosed values, as well as subranges from any two or more disclosed points. This term is also intended to disclose any subranges encompassed anywhere within the highest and lowest disclosed values, including between two points that are explicitly recited in the document, up to one decimal point. Thus, disclosure of values 0, 5, 10, 15, 20, including all ranges and subranges therebetween, should be interpreted as also encompassing a range from 0-20, a range from 0-5 or 5-15, as well as a range from 2-16, or 3.1 to 19.8, etc.

Unless otherwise indicated, it is to be understood that all numbers expressing quantities, ratios, and numerical properties of ingredients, reaction conditions, and so forth, used in the specification are contemplated to be able to be modified in all instances by the term "including all ranges and subranges therebetween".

Overview

The present disclosure provides novel enzymatically active domains (EADs), truncated enzymes, cell wall binding domains (CBDs), and chimeric cell wall hydrolases (CWHs) that exhibit binding and/or enzymatic activity against *Cutibacterium acnes*. Also provided herein are compositions comprising the EADs, truncated enzymes, CBDs, and chimeric CWHs, as well as uses thereof in targeting *Cutibacterium acnes* and treating conditions associated with *Cutibacterium acnes*.

CWHs are enzymes that degrade bacterial peptidoglycan by cleaving bonds in the peptidoglycan chain and side-chain branches. Degradation of peptidoglycan cell walls by CWHs can result in rapid lysis of a bacterial cell due to an inability to resist internal turgor pressure. The advantages of using CWHs to treat *Cutibacterium acnes* associated conditions include their high specificity. CWHs, e.g., gram-positive endolysins, have one or more cell wall-binding domains that bind specific epitopes within the target cell wall. Because the composition and organization of the peptidoglycan cell wall can vary greatly between bacterial species, CWHs often have lytic specificity down to a genus, species, or even subspecies. In active acne, the diversity of *C. acnes* phylotypes has decreased such that broad removal of resident *C. acnes* may help re-establish phylotype diversity. CWHs also provide a more direct and stable mechanism of action than phage therapy, another proposed antibiotic alternative.

As demonstrated in the Examples herein, the present disclosure provides novel and highly effective EADs, truncated enzymes, CBDs, and chimeric CWHs, exhibiting high lytic activity and/or *Cutibacterium acnes* species-specificity. In some embodiments, the chimeric CWH is composed of domains from parent proteins and has properties that are superior to any of the parent proteins. In some embodiments, CWHs herein bind very specific epitopes in target cell walls. In some embodiments, CWHs herein have lytic activity down to a single species or group of related species. Because of these properties, in some embodiments, the CWHs herein act as high-specificity skin microbiome modulators. For example, in some embodiments, CWHs herein are able to specifically kill or modulate the diversity of *Cutibacterium acnes*, while exhibiting significantly less activity against healthy, commensal bacteria.

Enzymatically Active Domains (EADs) and Truncated Enzymes

In some embodiments, a recombinant protein of the disclosure comprises an EAD, enzyme, or truncated enzyme disclosed herein. In some embodiments, a recombinant protein of the disclosure comprises an EAD disclosed herein. In some embodiments, a recombinant protein of the disclosure consists essentially of or consists of an EAD disclosed herein. In some embodiments, the recombinant protein is a chimeric protein or a chimeric CWH comprising an EAD. In some embodiments, a recombinant protein of the disclosure comprises an EAD disclosed herein in combination with a CBD disclosed herein.

The present disclosure provides novel enzymes and enzymatically active domains (EADs). The inventors of the present disclosure discovered a novel class of enzymes with activity against *C. acnes*, termed herein the CLC1-family enzymes. See FIGS. 1A-1B and Tables 1-2. As shown in the Examples herein, these novel enzymes, and the EADs they comprise, exhibit significant activity against *C. acnes*, even in the absence of a CBD.

TABLE 1

CLC1-family enzymes.

| ID | Organism | Genbank Acc. # | SEQ ID NO |
|---|---|---|---|
| CLC1 | Cutibacterium avidum TM16 | ERF59075.1 | 1 |
| CLC2 | Cutibacterium granulosum DSM 20700 | ERF55529.1 | 2 |
| CLC3 | Cutibacterium avidum | WP_065673254.1 | 3 |
| CLC4 | *Caudoviricetes* sp. | DAI62752.1 | 4 |
| CLC5 | Cutibacterium avidum | BCQ03178.1 | 5 |
| CLC6 | Cutibacterium avidum | MCO6633004.1 | 6 |
| CLC7 | Cutibacterium avidum | WP_279187040.1 | 7 |
| CLC8 | Cutibacterium avidum | WP_202725644.1 | 8 |
| CLC9 | Cutibacterium avidum | MCO6684721.1 | 9 |
| CLC10 | Cutibacterium porci | WP_154562382.1 | 10 |
| CLC11 | Cutibacterium granulosum DSM 20700 | KAG9059780.1 | 11 |
| CLC12 | Cutibacterium avidum | WP_252923283.1 | 12 |
| CLC13 | *Propionibacterium* sp. KPL2005 | ERS24858.1 | 13 |
| CLC14 | Cutibacterium avidum | WP_117188621.1 | 14 |
| CLC15 | *Caudoviricetes* sp. | DAX95823.1 | 15 |
| CLC16 | *Caudoviricetes* sp. | DAK10468.1 | 16 |
| CLC17 | Cutibacterium avidum | WP_202711633.1 | 17 |
| CLC18 | Cutibacterium avidum | MCO6632604.1 | 18 |
| CLC19 | Cutibacterium avidum | MCO6688344.1 | 19 |

TABLE 2

CLC1-family EADs.

| EAD | SEQ ID # | Amino Acid Sequence |
|---|---|---|
| CLC1-EAD | 20 | SNTPITRLVIHATCPDVGYPSASKAGRAVS TAEYFASTSRSASAHYVCDVSATVQCLSEE TIGYHAPPNSHSIGIEICADGGSRASFEKA SHAYTREQWLSPQVWPAVERAAILARGICH RHHIPVRKLTTAQVKSGMSGICGHDNVSDA FHQSDHDDPGP |
| CLC2-EAD | 21 | SNTPITRLVIHATCPDVGFPSASRAGRAVS TAEYFASTSRSASAHYVCDISTTVQCLSEA TIGYHAPPNAHSIGIEICADGGSRASFEKA SHAYTREQWLSPQVWPAVERAAILARDICH RHHIPIRRLSVAQVRAGERGICGHNEVSEA FHQSDHDDPGP |
| CLC3-EAD | 22 | SNAPITRLVIHATCPDVGYPSASKAGRAVS TANYFATTDRPASAHYVCDIATTVQCLSEE TIGYHAPPNSHSIGIEICADGGSHASFEKA SHAYTRDQWLSDDVWPAVERAAILARDICQ RHRIPVRKLSTAQVKAGLSGICGHDNVSGA FHQSDHDDPGP |
| CLC4-EAD | 23 | SNAPITRLVIHATCPDVGYPSASKAGRAVS TAEYFASTSRSASAHYVCDIAATVQCLSEE AIGFHAPPNSHSIGIEICADGGSRASFEKA SHAYTREQWLSPQVWPAVERAAILARDICR RHHIPVRKLTTAQVKSGMSGICGHDNVSDA FHQSDHDDPGP |
| CLC5-EAD | 24 | SNTPVTRLVIHATCPDVGYPSASKAGRAVS TAEYFASTSRSASAHYVCDVSATVQCLSEE |

TABLE 2-continued

CLC1-family EADs.

| EAD | SEQ ID # | Amino Acid Sequence |
|---|---|---|
|  |  | AIGYHAPPNSHSIGIEICADGGSHASFETA SHAYTREQWLSPQVWPAVERAAILARDICH RHHIPVRKLTTAQVKSGMSGICGHDNVSDA FRQSDHDDPGP |
| CLC6-EAD | 25 | SNNPVTRLVIHATCPDVGYPSASKAGRAVS TAQYFASTSRPASAHYVCDVSATVQCLSEE TIGYHAPPNAHSIGIEICSDGGSRASFEKA SHAYSREQWLSPQVWPAVERAAILARDICH RHRIPVRKLTAAQVKSGMSGICGHDNVSDA FRQSDHDDPGP |
| CLC7-EAD | 26 | SNAPITRLVIHATCPDVGYPSASKAGRAVS TAHYFAEATRPASAHYVCDVSATVQCLSEE TIGYHAPPNAHSIGIEICSDGGSRASFEKA SHAYSREQWLSPQVWPAVERAAILARDICH RHRIPVRKLTAAQVKSGMSGICGHDNVSDA FRQSDHDDPGP |
| CLC8-EAD | 27 | SNTPITRLVIHATCPDVGYPSASRAGRAAS TANYFATTDRPASAHYVCDIATTVQCLSEE VIGFHAPPNSHSIGIEICADGGSHASFEKA SHAYTREQWLSDDVWPAVERAAILARGICH RHHIPVRKLSTAQVKSGMSGICGHDNVSDA FHQSDHDDPGP |
| CLC9-EAD | 28 | TNAPVTRLVIHSTCPDVGFPSASRAGRAVS TAGYFASTSRPASAHYVVDVTTTVQCLPEN TIGYHAPPNSHSIGIEICSDGGSRASFENP SHAYTREQWLSPQVWPAVERAAILARGICH RHHIPVRKLTTAQVKNGMSGICGHDNVSDA FHQSDHDDPGP |
| CLC10-EAD | 29 | NTPVTRLVIHATCPDTGYPSASRAGRAAST ARYFQSTSRPTSAHYVCDVTATVQCLSEET IGYHAPPNAHSIGIEICADGGSKSSFDNPS HSYTREQWLSPQVWPAVERAAILARDICHR HHIPVRKLSTAQVKSGMSGICGHDNVSDAF HQSDHDDPGP |
| CLC11-EAD | 30 | SNTPITRLVIHATCPDVGFPSASRAGRAVS TAEYFASTSRSASAHYVCDISTTVQCLSEA TIGYHAPPNAHSIGIEICAAGGSRASFEKA SHAYTREQWLSPQVWPAVERAAILARDICH RHHIPIRRLSVAQVRAGERGICGHNEVSEA FHQSDHDDPGP |
| CLC12-EAD | 31 | TNAPVSRLVIHSTCPDVGFPSASRAGRAVS TAEYFASTSRPASAHYVVDIATTVQCLPEN TIGYHAPPNSHSIGIEICSDGGSRASFEKA SHAYTREQWLSPQVWPAVERAAILARDICH RHRIPVRKLSTAQVKNGMSGICGHDNVSDA FHQSDHDDPG |
| CLC13-EAD | 32 | TNAPVTRLVIHSTCPDVGFPSASRAGRAVS TAGYFASTSRPASAHYVVDVTTTVQCLPEN TIGYHAPPNSHSIGIEICSDGGSRASFENP SHAYTREQWLSPQVWPAVERAAILARDICH RHRIPVRKLSTAQVKNGMSGICGHDNVSDA FHQSDHDDPGP |
| CLC14-EAD | 33 | NNPPVTRLVIHATCPDVGYPSASRAGRAVS TAHYFQETTRPASAHYICDISTTVQCLSEE TVGYHAPPNSHSIGIEICADGGSHASFSNP AHAYTREQWLSPQVWPAVERAAMLARGICQ RHNIPIRRLSIADVKAGKRGICGHNEVSEA FHQSDHDDPGP |
| CLC15-EAD | 34 | SNKPVTRLVIHSTCPDVGFPSASRAGRAES TANYFADSSRPASAHYVCDVSTTIQCLHED VVGYHAPPNSHSIGIEICSDGGSRASFRNP NHAYTREQWLSPQVWPAVERAAVLARDICK RNGIPIRKLSTSEVKAGRSGICGHNNVSDA FHQSDHDDPGP |
| CLC16-EAD | 35 | SNKPVTRLVIHSTCPDVGFPSASRAGRAES TANYFADSSRPASAHYVCDVSTTIQCLHED IVGYHAPPNSHSIGIEICSDGGSHASFNNP KHAYTRDQWLSPQVWPAVERAAVLARDICK RNGIPIRKLSTSEVKAGRSGICGHNNVSDA FHQSDHDDPGP |
| CLC17-EAD | 36 | TNAPVSRIVIHSTCPDVGFPAASKAGRAVS TANYFASTSRPASAHYVVDIATTVQCLPEN TVGYHAPPNSGSIGIEICSDGGSKGSFENP AHAYTTTQWLSPEVWPAVERAAILAREICH RHHIPIRRLSVAQVRAGERGICGHNEVSEA FHRSDHDDPGP |

In some embodiments, a recombinant protein of the disclosure comprises a CLC1-family EAD. In some embodiments, a recombinant protein of the disclosure comprises an EAD having at least 40, 45, 50, 55, 60, 65, 70, 75, 80, 85, 90, 95, 96, 97, 98, 99, or 100% sequence identity to a CLC1-family EAD. In some embodiments, a recombinant protein of the disclosure comprises an EAD having at least 80, 81, 82, 83, 84, 85, 86, 87, 88, 89, 90, 91, 92, 93, 94, 95, 96, 97, 98, 99, or 100% sequence identity to a CLC1-family EAD. In some embodiments, a recombinant protein of the disclosure comprises an EAD differing by 1, 2, 3, 4, 5, 6, 7, 8, 9, 10, 11, 12, 13, 14, or 15 amino acids from a CLC1-family EAD.

In some embodiments, a recombinant protein of the disclosure comprises a CLC1-family EAD disclosed in Table 2. In some embodiments, a recombinant protein of the disclosure comprises an EAD having at least 40, 45, 50, 55, 60, 65, 70, 75, 80, 85, 90, 95, 96, 97, 98, 99, or 100% sequence identity to a CLC1-family EAD disclosed in Table 2. In some embodiments, a recombinant protein of the disclosure comprises an EAD having at least 80, 81, 82, 83, 84, 85, 86, 87, 88, 89, 90, 91, 92, 93, 94, 95, 96, 97, 98, 99, or 100% sequence identity to a CLC1-family EAD disclosed in Table 2. In some embodiments, a recombinant protein of the disclosure comprises an EAD differing by 1, 2, 3, 4, 5, 6, 7, 8, 9, 10, 11, 12, 13, 14, or 15 amino acids from a CLC1-family EAD disclosed in Table 2.

In some embodiments, a recombinant protein of the disclosure comprises the CLC16 EAD (SEQ ID NO: 35). In some embodiments, a recombinant protein of the disclosure comprises an EAD having at least 40, 45, 50, 55, 60, 65, 70, 75, 80, 85, 90, 95, 96, 97, 98, 99, or 100% sequence identity to the CLC16 EAD (SEQ ID NO: 35). In some embodiments, a recombinant protein of the disclosure comprises an EAD having at least 80, 81, 82, 83, 84, 85, 86, 87, 88, 89, 90, 91, 92, 93, 94, 95, 96, 97, 98, 99, or 100% sequence identity to the CLC16 EAD (SEQ ID NO: 35). In some embodiments, a recombinant protein of the disclosure comprises an EAD differing by 1, 2, 3, 4, 5, 6, 7, 8, 9, 10, 11, 12, 13, 14, or 15 amino acids from the CLC16 EAD (SEQ ID NO: 35).

In some embodiments, a recombinant protein of the disclosure comprises the CLC2 EAD (SEQ ID NO: 21). In some embodiments, a recombinant protein of the disclosure comprises an EAD having at least 40, 45, 50, 55, 60, 65, 70, 75, 80, 85, 90, 95, 96, 97, 98, 99, or 100% sequence identity to the CLC2 EAD (SEQ ID NO: 21). In some embodiments, a recombinant protein of the disclosure comprises an EAD having at least 80, 81, 82, 83, 84, 85, 86, 87, 88, 89, 90, 91, 92, 93, 94, 95, 96, 97, 98, 99, or 100% sequence identity to the CLC2 EAD (SEQ ID NO: 21). In some embodiments, a recombinant protein of the disclosure comprises an EAD differing by 1, 2, 3, 4, 5, 6, 7, 8, 9, 10, 11, 12, 13, 14, or 15 amino acids from the CLC2 EAD (SEQ ID NO: 21).

The newly discovered CLC1-family EADs share a conserved sequence motif, the "CLC1-family EAD motif," having the following sequence, where X represents any amino acid:

```
                                        (SEQ ID NO: 2939)
XNXPXXXRXVIHXTCPDXGXPXASXAGRAXSTAXYFXXXXRXXSAH

YXXDXXXTXQCLXEXXXGXHAPPNXXSIGIEICXXGGSXXSFXXX

XHXYXXXQWLSXXVWPAVERAAXLARXICXRXXIPXRXLXXXXVX

XGXXGICGHXXVSXAFXXSDHDDPGX.
```

In some embodiments, a recombinant protein of the disclosure comprises an EAD comprising the CLC1-family EAD motif (SEQ ID NO: 2939). In some embodiments, a recombinant protein of the disclosure comprises an EAD comprising the CLC1-family EAD motif (SEQ ID NO: 2939) and having at least 40, 45, 50, 55, 60, 65, 70, 75, 80, 85, 90, 95, 96, 97, 98, 99, or 100% sequence identity to a CLC1-family EAD disclosed in Table 2. In some embodiments, a recombinant protein of the disclosure comprises an EAD comprising the CLC1-family EAD motif (SEQ ID NO: 2939) and having at least 80, 81, 82, 83, 84, 85, 86, 87, 88, 89, 90, 91, 92, 93, 94, 95, 96, 97, 98, 99, or 100% sequence identity to a CLC1-family EAD disclosed in Table 2. In some embodiments, a recombinant protein of the disclosure comprises an EAD comprising the CLC1-family EAD motif (SEQ ID NO: 2939) and differing by 1, 2, 3, 4, 5, 6, 7, 8, 9, 10, 11, 12, 13, 14, or 15 amino acids from a CLC1-family EAD disclosed in Table 2.

In some embodiments, a recombinant protein of the disclosure comprises an EAD consisting of a sequence according to any one of SEQ ID NO: 20-36 or the EAD region of any one of SEQ ID NO: 1-19. In some embodiments, a recombinant protein of the disclosure comprises an EAD comprising a sequence according to any one of SEQ ID NO: 20-36 or the EAD region of any one of SEQ ID NO: 1-19. In some embodiments, a recombinant protein of the disclosure comprises an EAD having at least 80, 81, 82, 83, 84, 85, 86, 87, 88, 89, 90, 91, 92, 93, 94, 95, 96, 97, 98, or 99 identity with a sequence according to any one of SEQ ID NO: 20-36 or the EAD region of any one of SEQ ID NO: 1-19. In some embodiments, a recombinant protein of the disclosure comprises an EAD differing by 1, 2, 3, 4, 5, 6, 7, 8, 9, 10, 11, 12, 13, 14, or 15 amino acids from a sequence according to any one of SEQ ID NO: 20-36 or the EAD region of any one of SEQ ID NO: 1-19.

TABLE 3

Additional enzymes of the disclosure.

| Description Taxonomy GenBank Acc. No. | Sequence |
| --- | --- |
| CD27L Clostridioides difficile WP_009898411.1 SEQ ID NO: 60 | MKICITVGHSILKSGACTSADGVVNEYQYNKSLAPVLADTFRK EGHKVDVIICPEKQFKTKNEEKSYKIPRVNSGGYDLLIELHLN ASNGQGKGSEVLYYSNKGLEYATRICDKLGTVFKNRGAKLDKR LYILNSSKPTAVLIESFFCDNKEDYDKAKKLGHEGIAKLIVEG VLNKNINNEGVKQMYKHTIVYDGEVDKISATVVGWGYNDGKIL ICDIKDYVPGQTQNLYVVGGGACEKISSITKEKFIMIKGNDRF DTLYKALDFINR |
| PlyGVE2 Geobacillus virus E2 YP_001285830.1 SEQ ID NO: 61 | MKKIFWDKGHGGSDPGAVANGLQEKNLTHKIVEYATDYLAAH YEGFTQRVSREGDQSLTLDQRADMANKWGADVFVSVHINAGK GTGFEIYVHPNASPQSIALQNVLHGEILSAMRQFGNITDRGK KRANYAVLRETKMPAVLTENLFIDSNDAKHLKNEAFLKAVGE AHARGVAKFLGLKEKQKAQPEAKPQQKPSDKKLYRVQVGAFA DRENAERLAEELKRKGYPVYITD |
| PlyD6E Deep-sea thermophilic phage D6E YP_007010941.1 SEQ ID NO: 62 | MVRIVLDAGHGGKDSGAVGNGLREKDLTLNIVKKIGNLLAEYE GVEVHYTRTDDRFLELSERAEIANRLKADYFISVHINAGGGTG FESYIYNGNVSSATIAYQNVIHSEIMKAIGNVTDRGKKRANYA VLRETHMPALLTENLFIDNKNDAAKLDSEQFLLQVAHGHVQGI VKAFGLKKKATPQPQQKVSDKKLYRVQVGAFADRKNAERLADE LKKKGYPVYITD |
| CaLys1 Propionibacterium phage ATCC29399B_T YP_006906916.1 SEQ ID NO: 72 | MRYIPAAHHSAGSNHPVNRVVIHATCPDVGFPSASRKGRAVST ANYFASPSSGGSAHYVCDIGETVQCLSEGTIGWHAPPNPHSLG IEICADGGSHASFRVPGHAYTREQWLDPRVWPAVEKAAILCRR LCDKYNVPKRKLSAADLKAGRRGVCGHVDVTDAWHQSDHDDPG PWFPWDRFMAVVNGHNESGELTVADVKALHDQIKQLSAQLAGS VNKLHHDVGVVQVQNGDLGKRVDALSWVKNPVTGKLWRTKDAL WSVWYYVLECRSRIDRLESAVNGLKK |

TABLE 4

Additional EADs of the disclosure.

| Description & SEQ ID NO | Sequence |
| --- | --- |
| CD27L-EAD SEQ ID NO: 63 | MKICITVGHSILKSGACTSADGVVNEYQYNK SLAPVLADTFRKEGHKVDVIICPEKQFKTKN EEKSYKIPRVNSGGYDLLIELHLNASNGQGK GSEVLYYSNKGLEYATRICDKLGTVFKNRGA |

TABLE 4-continued

Additional EADs of the disclosure.

| Description & SEQ ID NO | Sequence |
|---|---|
| | KLDKRLYILNSSKPTAVLIESFFCDNKEDYD |
| | KAKKLGHEGIAKLIVEGVLNKNINNEGVKQM |
| | YKHTIVYDGEVDK |
| PlyGVE2-EAD SEQ ID NO: 64 | MKKIFWDKGHGGSDPGAVANGLQEKNLTHKI VEYATDYLAAHYEGFTQRVSREGDQSLTLDQ RADMANKWGADVFVSVHINAGKGTGFEIYVH PNASPQSIALQNVLHGEILSAMRQFGNITDR GKKRANYAVLRETKMPAVLTENLFIDSNDAK HLKNEAFLKAVGEAHARGVAKFLGLK |
| PlyD6E-EAD SEQ ID NO: 65 | MVRIVLDAGHGGKDSGAVGNGLREKDLTLNIV KKIGNLLAEYEGVEVHYTRTDDRFLELSERAE IANRLKADYFISVHINAGGGTGFESYIYNGNV SSATIAYQNVIHSEIMKAIGNVTDRGKKRANY AVLRETHMPALLTENLFIDNKNDAAKLDSEQF LLQVAHGHVQGIVKAFGLKKKAT |
| CaLys1-EAD SEQ ID NO: 66 | SNHPVNRVVIHATCPDVGFPSASRK-GRAVSTANY FASPSSGGSAHYVCDI-GETVQCLSEGTIGWHAPP NPHSLGIEICADGGSHASFRVPGHAY-TREQWLDP RVWPAVEKAAILCRRLCDKYNVPKRKL-SAADLKA GRRGVCGHVDVTDAWHQSDHDDPGP |

In some embodiments, a recombinant protein of the disclosure comprises an EAD consisting of a sequence in Table 4 or the EAD region of a sequence in Table 3. In some embodiments, a recombinant protein of the disclosure comprises an EAD comprising a sequence in Table 4 or the EAD region of a sequence in Table 3. In some embodiments, a recombinant protein of the disclosure comprises an EAD having at least 80, 81, 82, 83, 84, 85, 86, 87, 88, 89, 90, 91, 92, 93, 94, 95, 96, 97, 98, or 99% identity with a sequence in Table 4 or the EAD region of a sequence in Table 3. In some embodiments, a recombinant protein of the disclosure comprises an EAD differing by 1, 2, 3, 4, 5, 6, 7, 8, 9, 10, 11, 12, 13, 14, or 15 amino acids from a sequence in Table 4 or the EAD region of a sequence in Table 3.

In some embodiments, a recombinant protein of the disclosure comprises an EAD from CD27L or PlyGVE2. In some embodiments, a recombinant protein of the disclosure comprises an EAD consisting of a sequence according to any one of SEQ ID NO: 63-64 or the EAD region of any one of SEQ ID NO: 60-61. In some embodiments, a recombinant protein of the disclosure comprises an EAD comprising a sequence according to any one of SEQ ID NO: 63-64 or the EAD region of any one of SEQ ID NO: 60-61. In some embodiments, a recombinant protein of the disclosure comprises an EAD having at least 80, 81, 82, 83, 84, 85, 86, 87, 88, 89, 90, 91, 92, 93, 94, 95, 96, 97, 98, or 99% identity with a sequence according to any one of SEQ ID NO: 63-64 or the EAD region of any one of SEQ ID NO: 60-61. In some embodiments, a recombinant protein of the disclosure comprises an EAD differing by 1, 2, 3, 4, 5, 6, 7, 8, 9, 10, 11, 12, 13, 14, or 15 amino acids from a sequence according to any one of SEQ ID NO: 63-64 or the EAD region of any one of SEQ ID NO: 60-61.

In some embodiments, a recombinant protein of the disclosure comprises the EAD of CaLys1. In some embodiments, a recombinant protein of the disclosure comprises an EAD consisting of a sequence according to SEQ ID NO: 73 or the EAD region of SEQ ID NO: 72. In some embodiments, a recombinant protein of the disclosure comprises an EAD comprising a sequence according to SEQ ID NO: 73 or the EAD region of SEQ ID NO: 72. In some embodiments, a recombinant protein of the disclosure comprises an EAD having at least 80, 81, 82, 83, 84, 85, 86, 87, 88, 89, 90, 91, 92, 93, 94, 95, 96, 97, 98, or 99% identity with a sequence according to SEQ ID NO: 73 or the EAD region of SEQ ID NO: 72. In some embodiments, a recombinant protein of the disclosure comprises an EAD differing by 1, 2, 3, 4, 5, 6, 7, 8, 9, 10, 11, 12, 13, 14, or 15 amino acids from a sequence according to SEQ ID NO: 73 or the EAD region of SEQ ID NO: 72.

In some embodiments, a recombinant protein of the disclosure comprises an EAD derived from a lysin. In some embodiments, the lysin is an endolysin, a tail lysin, an exolysin, a bacteriocin, or an autolysin. In some embodiments, the EAD is derived from any one of the endolysins listed herein. In some embodiments, the EAD is a glycosidase. In some embodiments, the EAD is an amidase. In some embodiments, the EAD is a peptidase.

In some embodiments, a recombinant protein herein comprises an EAD according to any one of the foregoing embodiments. In some embodiments, a recombinant protein herein comprises 1 EAD. In some embodiments, the recombinant protein comprises more than one EAD. In some embodiments, the recombinant protein comprises 2 EADs. In some embodiments, the recombinant protein comprises 3, 4, 5, 6, 7, 8, 9, or 10 EADs.

Truncated Enzymes

In one aspect, the present disclosure provides truncated enzymes with lytic activity against *C. acnes*. As demonstrated in the Examples herein, the inventors surprisingly discovered that truncation of a conserved C-terminal region of CLC1-family enzymes and CaLys1 led to truncated enzymes with higher lytic activity than the corresponding full-length native protein. Table 5 provides illustrative truncated enzymes of the disclosure.

TABLE 5

CaLys1 and CLC1-family truncations.

| Description & SEQ ID | Amino Acid Sequence |
|---|---|
| CaLys1-truncation, SEQ ID | MVRYIPAAHHSAGSNHPVNRVVIHATCPDVGFPSASRKGRAVSTANYF ASPSSGGSAHYVCDIGETVQCLSEGTIGWHAPPNPHSLGIEICADGGS HASFRVPGHAYTREQWLDPRVWPAVEKAAILCRRLCDKYNVPKRKLSA |

TABLE 5-continued

CaLys1 and CLC1-family truncations.

| Description & SEQ ID | Amino Acid Sequence |
|---|---|
| NO: 74 | ADLKAGRRGVCGHVDVTDAWHQSDHDDPGPWFPWDRFMAVVNGHNE<br>SGELTVADVK |
| CLC1-<br>truncation,<br>SEQ ID<br>NO: 75 | MTFIQARHHGGNSNTPITRLVIHATCPDVGYPSASKAGRAVSTAEYFAS<br>TSRSASAHYVCDVSATVQCLSEETIGYHAPPNSHSIGIEICADGGSRAS<br>FEKASHAYTREQWLSPQVWPAVERAAILARGICHRHHIPVRKLTTAQVK<br>SGMSGICGHDNVSDAFHQSDHDDPGPYFPWNEFIAAIQGKNTNKGELSM<br>SDV |
| CLC2-<br>truncation,<br>SEQ ID<br>NO: 76 | MTFIQAAHRGGTSNTPITRLVIHATCPDVGFPSASRAGRAVSTAEYFAST<br>SRSASAHYVCDISTTVQCLSEATIGYHAPPNAHSIGIEICADGGSRASFE<br>KASHAYTREQWLSPQVWPAVERAAILARDICHRHHIPIRRLSVAQVRAGE<br>RGICGHNEVSEAFHQSDHDDPGPYFPWNEFIAAVQGKTTTPEGELSMSD |
| CLC3-<br>truncation,<br>SEQ ID<br>NO: 77 | MTFIQARHHGGNSNAPITRLVIHATCPDVGYPSASKAGRAVSTANYFATT<br>DRPASAHYVCDIATTVQCLSEETIGYHAPPNSHSIGIEICADGGSHASFE<br>KASHAYTRDQWLSDDVWPAVERAAILARDICQRHRIPVRKLSTAQVKA<br>GLSGICGHDNVSGAFHQSDHDDPGPYFPWDQFMALVQGKPATPGDLT<br>MADI |
| CLC4-<br>truncation,<br>SEQ ID<br>NO: 78 | MTFIQARHHGGNSNAPITRLVIHATCPDVGYPSASKAGRAVSTAEYFAS<br>TSRSASAHYVCDIAATVQCLSEEAIGFHAPPNSHSIGIEICADGGSRAS<br>FEKASHAYTREQWLSPQVWPAVERAAILARDICRRHHIPVRKLTTAQVK<br>SGMSGICGHDNVSDAFHQSDHDDPGPYFPWNEFIAAVQGKNTNKGELS<br>MSDV |
| CLC5-<br>truncation,<br>SEQ ID<br>NO: 79 | MTFIQARHHGGNSNTPVTRLVIHATCPDVGYPSASKAGRAVSTAEYFAS<br>TSRSASAHYVCDVSATVQCLSEEAIGYHAPPNSHSIGIEICADGGSHASF<br>ETASHAYTREQWLSPQVWPAVERAAILARDICHRHHIPVRKLTTAQVKS<br>GMSGICGHDNVSDAFRQSDHDDPGPYFPWNEFIAAVQGKTTNKGELSM<br>SDV |
| CLC6-<br>truncation,<br>SEQ ID<br>NO: 80 | MTFIQARHHGGNSNNPVTRLVIHATCPDVGYPSASKAGRAVSTAQYFA<br>STSRPASAHYVCDVSATVQCLSEETIGYHAPPNAHSIGIEICSDGGSRASF<br>EKASHAYSREQWLSPQVWPAVERAAILARDICHRHRIPVRKLTAAQVK<br>SGMSGICGHDNVSDAFRQSDHDDPGPYFPWNEFIAAVQGKNTNKGELS<br>MSDV |
| CLC7-<br>truncation,<br>SEQ ID<br>NO: 81 | MTFIQARHHGGNSNAPITRLVIHATCPDVGYPSASKAGRAVSTAHYFAE<br>ATRPASAHYVCDVSATVQCLSEETIGYHAPPNAHSIGIEICSDGGSRASF<br>EKASHAYSREQWLSPQVWPAVERAAILARDICHRHRIPVRKLTAAQVK<br>SGMSGICGHDNVSDAFRQSDHDDPGPYFPWNEFIAAVQGKTTNKGELS<br>MSDV |
| CLC8-<br>truncation,<br>SEQ ID<br>NO: 82 | MTFIQARHHGGNSNTPITRLVIHATCPDVGYPSASRAGRAASTANYFAT<br>TDRPASAHYVCDIATTVQCLSEEVIGFHAPPNSHSIGIEICADGGSHASFE<br>KASHAYTREQWLSDDVWPAVERAAILARGICHRHHIPVRKLSTAQVKS<br>GMSGICGHDNVSDAFHQSDHDDPGPHFPWNEFIAAVQGKTTNKGELSM<br>SDV |
| CLC9-<br>truncation,<br>SEQ ID<br>NO: 83 | MTFIQARHHGGNTNAPVTRLVIHSTCPDVGFPSASRAGRAVSTAGYFAS<br>TSRPASAHYVVDVTTTVQCLPENTIGYHAPPNSHSIGIEICSDGGSRASFE<br>NPSHAYTREQWLSPQVWPAVERAAILARGICHRHHIPVRKLTTAQVKN<br>GMSGICGHDNVSDAFHQSDHDDPGPYFPWDKFIAAVQGKNTTSEGELS<br>MSDI |
| CLC10-<br>truncation,<br>SEQ ID<br>NO: 84 | MQFIQAKHHGGNENTPVTRLVIHATCPDTGYPSASRAGRAASTARYFQS<br>TSRPTSAHYVCDVTATVQCLSEETIGYHAPPNAHSIGIEICADGGSKSSFD<br>NPSHSYTREQWLSPQVWPAVERAAILARDICHRHHIPVRKLSTAQVKSG<br>MSGICGHDNVSDAFHQSDHDDPGPYFPWDRFMAAITNTHPEELTMADV |
| CLC11-<br>truncation,<br>SEQ ID<br>NO: 85 | MTFIQAAHRGGTSNTPITRLVIHATCPDVGFPSASRAGRAVSTAEYFAST<br>SRSASAHYVCDISTTVQCLSEATIGYHAPPNAHSIGIEICAAGGSRASFEK<br>ASHAYTREQWLSPQVWPAVERAAILARDICHRHHIPIRRLSVAQVRAGE<br>RGICGHNEVSEAFHQSDHDDPGPYFPWNEFIAAVQGKTTTPEGELSMSD<br>V |
| CLC12-<br>truncation,<br>SEQ ID<br>NO: 86 | MTFIQARHHGGNTNAPVSRLVIHSTCPDVGFPSASRAGRAVSTAEYFAS<br>TSRPASAHYVVDIATTVQCLPENTIGYHAPPNSHSIGIEICSDGGSRASFE<br>KASHAYTREQWLSPQVWPAVERAAILARDICHRHRIPVRKLSTAQVKN<br>GMSGICGHDNVSDAFHQSDHDDPGLYFPWDRFIAAIQGKNTTTKGELS<br>MSDV |
| CLC13-<br>truncation,<br>SEQ ID | MTFIQARHHGGNTNAPVTRLVIHSTCPDVGFPSASRAGRAVSTAGYFAS<br>TSRPASAHYVVDVTTTVQCLPENTIGYHAPPNSHSIGIEICSDGGSRASFE<br>NPSHAYTREQWLSPQVWPAVERAAILARDICHRHRIPVRKLSTAQVKN |

TABLE 5-continued

CaLys1 and CLC1-family truncations.

| Description & SEQ ID | Amino Acid Sequence |
|---|---|
| NO: 87 | GMSGICGHDNVSDAFHQSDHDDPGPYFPWDKFIAAVQGKNTTSEGELSMSDI |
| CLC14-truncation, SEQ ID NO: 88 | MTFIQAKHHGGHNNPPVTRLVIHATCPDVGYPSASRAGRAVSTAHYFQETTRPASAHYICDISTTVQCLSEETVGYHAPPNSHSIGIEICADGGSHASFSNPAHAYTREQWLSPQVWPAVERAAMLARGICQRHNIPIRRLSIADVKAGKRGICGHNEVSEAFHQSDHDDPGPYFPWDGFIALVNGHSAPSRQEELTVSDVH |
| CLC15-truncation, SEQ ID NO: 89 | MRYIQAKHHGGASNKPVTRLVIHSTCPDVGFPSASRAGRAESTANYFADSSRPASAHYVCDVSTTIQCLHEDVVGYHAPPNSHSIGIEICSDGGSRASFRNPNHAYTREQWLSPQVWPAVERAAVLARDICKRNGIPIRKLSTSEVKAGRSGICGHNNVSDAFHQSDHDDPGPYFPWDKFIAAVNGAKVTSEGALSMSDV |
| CLC16-truncation, SEQ ID NO: 90 | MRYIQAKHHGAASNKPVTRLVIHSTCPDVGFPSASRAGRAESTANYFADSSRPASAHYVCDVSTTIQCLHEDIVGYHAPPNSHSIGIEICSDGGSHASFNNPKHAYTRDQWLSPQVWPAVERAAVLARDICKRNGIPIRKLSTSEVKAGRSGICGHNNVSDAFHQSDHDDPGPYFPWDKFIAAVNGAKVTSEGALSMSDV |
| CLC17-truncation, SEQ ID NO: 91 | MTYIPAAHHGPTTNAPVSRIVIHSTCPDVGFPAASKAGRAVSTANYFASTSRPASAHYVVDIATTVQCLPENTVGYHAPPNSGSIGIEICSDGGSKGSFENPAHAYTTTQWLSPEVWPAVERAAILAREICHRHHIPIRRLSVAQVRAGERGICGHNEVSEAFHRSDHDDPGPWFPWDRFILEVKGIPTEGMSMSDI |
| CLC18-truncation, SEQ ID NO: 92 | MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDV |
| CLC19-truncation, SEQ ID NO: 93 | MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARDICHRHRIPVRKLSTAQVKNGMSGICGHDNVSDAFHQSDHDDPGPYFPWDKFIAAVQGKNTTSEGELSMSDI |

In some embodiments, a recombinant protein of the disclosure comprises a truncated enzyme sequence disclosed herein. In some embodiments, a recombinant protein of the disclosure consists of a truncated enzyme sequence disclosed herein. In some embodiments, a recombinant protein of the disclosure comprises a truncated enzyme having at least 80, 81, 82, 83, 84, 85, 86, 87, 88, 89, 90, 91, 92, 93, 94, 95, 96, 97, 98, or 99% identity with a truncated enzyme sequence disclosed herein. In some embodiments, a recombinant protein of the disclosure comprises a truncated enzyme that differs by 1, 2, 3, 4, 5, 6, 7, 8, 9, 10, 11, 12, 13, 14, or 15 amino acids from a sequence disclosed herein.

In some embodiments, a recombinant protein of the disclosure comprises a truncated enzyme sequence disclosed in Table 5. In some embodiments, a recombinant protein of the disclosure consists of a truncated enzyme sequence disclosed in Table 5. In some embodiments, a recombinant protein of the disclosure comprises a truncated enzyme having at least 80, 81, 82, 83, 84, 85, 86, 87, 88, 89, 90, 91, 92, 93, 94, 95, 96, 97, 98, or 99% identity with a truncated enzyme sequence disclosed in Table 5. In some embodiments, a recombinant protein of the disclosure comprises a truncated enzyme that differs by 1, 2, 3, 4, 5, 6, 7, 8, 9, 10, 11, 12, 13, 14, or 15 amino acids from a sequence disclosed in Table 5.

In some embodiments, a recombinant protein of the disclosure comprises a C-terminal truncation of an enzyme sequence disclosed in Table 1 or Table 3. In some embodiments, a recombinant protein of the disclosure consists of a C-terminal truncation of an enzyme sequence disclosed in Table 1 or Table 3. In some embodiments, a recombinant protein of the disclosure comprises a truncated enzyme having at least 80, 81, 82, 83, 84, 85, 86, 87, 88, 89, 90, 91, 92, 93, 94, 95, 96, 97, 98, or 99% identity with a C-terminal truncation of an enzyme sequence disclosed in Table 1 or Table 3. In some embodiments, a recombinant protein of the disclosure comprises a truncated enzyme that differs by 1, 2, 3, 4, 5, 6, 7, 8, 9, 10, 11, 12, 13, 14, or 15 amino acids from a C-terminal truncation of an enzyme sequence disclosed in Table 1 or Table 3.

In some embodiments, the C-terminal truncation is a truncation of the entire C-terminal region following the EAD. In some embodiments, the C-terminal truncation is a truncation of the conserved C-terminal tail. In some embodiments, the C-terminal truncation is a truncation of the C-terminal region of the enzyme that does not have any protein domain annotation. In some embodiments, the C-terminal truncation is a truncation of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 amino acids from the C terminus. In some embodiments, the C-terminal truncation is a truncation of about 10, 15, 20, 25, 30, 35, 40, 45, 50, 55, 60, 65, 70, 75, 80, 85, 90, 95, 100, 105, 110, 115, 120, 125, 130, 135, 140, 145, or 150 amino acids from the C-terminus. In some embodiments, the C-terminal truncation is a truncation of about 60-90 amino acids from the C-terminus.

In some embodiments, the truncated enzyme is truncated CLC1 and the truncation is a truncation of about 60-90 amino acids from the full-length CLC1 enzyme. In some embodiments, the truncated enzyme is truncated CLC1 and the truncation is a truncation of about 60-90 amino acids from the full-length CLC1 enzyme. In some embodiments, the truncated enzyme is truncated CLC1 and the truncation is a truncation of about 60-90 amino acids from the full-length CLC1 enzyme.

In some embodiments, the truncated enzyme is truncated CaLys1, CLC1, CLC2, CLC3, CLC4, CLC5, CLC6, CLC7, CLC8, CLC9, CLC10, CLC11, CLC12, CLC13, CLC14, CLC16, CLC18, or CLC19 and the truncation is a truncation of about 50-90 amino acids from the C-terminus of the full-length, native enzyme. In some embodiments, the truncated enzyme is truncated CaLys1, CLC1, CLC2, CLC3, CLC4, CLC5, CLC6, CLC7, CLC8, CLC9, CLC10, CLC11, CLC12, CLC13, CLC14, CLC16, CLC18, or CLC19 and the truncation is a truncation of about 80-85 amino acids from the C-terminus of the full-length, native enzyme.

In some embodiments, the truncated enzyme is truncated CLC15 and the truncation is a truncation of about 90-130 amino acids from the full-length CLC15 enzyme. In some embodiments, the truncated enzyme is truncated CLC15 and the truncation is a truncation of about 120-125 amino acids from the full-length CLC15 enzyme.

In some embodiments, the truncated enzyme is truncated CLC17 and the truncation is a truncation of about 30-70 amino acids from the full-length CLC17 enzyme. In some embodiments, the truncated enzyme is truncated CLC17 and the truncation is a truncation of about 60-70 amino acids from the full-length CLC17 enzyme.

Cell Wall Binding Domains (CBDs)

In some embodiments, a recombinant protein of the disclosure comprises a cell wall binding domain (CBD).

The inventors discovered a novel class of *C. acnes* binding CBDs comprising CW_7 sequences. As shown in the Examples of the disclosure, a wide variety of these CW_7 CBDs were able to increase lytic activity against *C. acnes* in combination with a CLC1-family EAD compared to the corresponding full-length CLC1-family enzyme. Information for CLB1-4 is provided in Table 6.

TABLE 6

CLB1-4 Taxonomy, GenBank Acc. No. and Sequences.

| Protein | Taxonomy | GenBank Acc. No. | Full length SEQ ID | CBD SEQ ID | CW_7 SEQ IDs |
|---------|----------|------------------|--------------------|-----------|--------------|
| CLB1 | Cutibacterium avidum | WP_015583338.1 | 37 | 41 | 45, 46 |
| CLB2 | Cutibacterium acnes | WP_002535464.1 | 38 | 42 | 47 |
| CLB3 | Propionimicrobium lymphoophilum | WP_016455084.1 | 39 | 43 | 48, 49 |
| CLB4 | Propionimicrobium lymphoophilum | WP_016456264.1 | 40 | 44 | 50, 51 |

In some embodiments, a recombinant protein of the disclosure comprises a CBD comprising a CW_7 sequence. In some embodiments, a recombinant protein of the disclosure comprises a CBD comprising a CW_7 sequence disclosed herein. In some embodiments, a recombinant protein of the disclosure comprises a CBD comprising a CW_7 sequence assigned to Interpro domain entry IPR013168. In some embodiments, the CBD consists of a CW_7 sequence.

In some embodiments, a recombinant protein of the disclosure comprises the CBD of any one of CLB1-4. In some embodiments, the CBD consists of a sequence according to any one of SEQ ID NO: 41-44 or the CBD region of any one of SEQ ID NO: 37-40. In some embodiments, the CBD comprises a sequence according to any one of SEQ ID NO: 41-44 or the CBD region of any one of SEQ ID NO: 37-40. In some embodiments, the CBD has at least 80, 81, 82, 83, 84, 85, 86, 87, 88, 89, 90, 91, 92, 93, 94, 95, 96, 97, 98, or 99% identity with a sequence according to any one of SEQ ID NO: 41-44 or the CBD region of any one of SEQ ID NO: 37-40. In some embodiments, the CBD differs by 1, 2, 3, 4, 5, 6, 7, 8, 9, 10, 11, 12, 13, 14, or 15 amino acids from a sequence according to any one of SEQ ID NO: 41-44 or the CBD region of any one of SEQ ID NO: 37-40.

In some embodiments, a recombinant protein of the disclosure comprises the CBD of CLB2. In some embodiments, the CBD consists of a sequence according to SEQ ID NO: 42 or the CBD region of SEQ ID NO: 38. In some embodiments, the CBD comprises a sequence according to SEQ ID NO: 42 or the CBD region of SEQ ID NO: 38. In some embodiments, the CBD has at least 80, 81, 82, 83, 84, 85, 86, 87, 88, 89, 90, 91, 92, 93, 94, 95, 96, 97, 98, or 99% identity with a sequence according to SEQ ID NO: 42 or the CBD region of SEQ ID NO: 38. In some embodiments, the CBD differs by 1, 2, 3, 4, 5, 6, 7, 8, 9, 10, 11, 12, 13, 14, or 15 amino acids from a sequence according to SEQ ID NO: 42 or the CBD region of SEQ ID NO: 38.

In some embodiments, a recombinant protein of the disclosure comprises a CBD comprising a CW_7 sequence from CLB1-4. In some embodiments, the CW_7 sequence consists of a sequence according to any one of SEQ ID NO: 45-51. In some embodiments, the CW_7 sequence comprises a sequence according to any one of SEQ ID NO: 45-51. In some embodiments, the CW_7 sequence has at least 40, 45, 50, 55, 60, 65, 70, 75, 80, 85, 90, or 95% identity with a sequence according to any one of SEQ ID NO: 45-51. In some embodiments, the CW_7 sequence comprises a sequence according to any one of SEQ ID NO: 45-51. In some embodiments, the CW_7 sequence has at least 80, 81, 82, 83, 84, 85, 86, 87, 88, 89, 90, 91, 92, 93, 94, 95, 96, 97, 98, or 99% identity with a sequence according to any one of SEQ ID NO: 45-51. In some embodiments, the CW_7 sequence differs by 1, 2, 3, 4, 5, 6, 7, 8, 9, 10, 11, 12, 13, 14, or 15 amino acids from a sequence according to any one of SEQ ID NO: 45-51.

In some embodiments, a recombinant protein of the disclosure comprises a CBD comprising the CW_7 sequence of CLB2. In some embodiments, the CW_7 sequence consists of a sequence according to SEQ ID NO: 47. In some embodiments, the CW_7 sequence comprises a sequence according to SEQ ID NO: 47. In some embodiments, the CW_7 sequence has at least 40, 45, 50, 55, 60, 65, 70, 75, 80, 85, 90, or 95% identity with a sequence according to SEQ ID NO: 47. In some embodiments, the CW_7 sequence comprises a sequence according to SEQ ID NO: 47. In some embodiments, the CW_7 sequence has at least 80, 81, 82, 83, 84, 85, 86, 87, 88, 89, 90, 91, 92, 93, 94, 95, 96, 97, 98, or 99% identity with a sequence according to SEQ ID NO: 47. In some embodiments, the CW_7 sequence differs by 1, 2, 3, 4, 5, 6, 7, 8, 9, 10, 11, 12, 13, 14, or 15 amino acids from a sequence according to SEQ ID NO: 47.

In some embodiments, a recombinant protein of the disclosure comprises the CBD of any one of the CPL-designated proteins exemplified in the Examples herein. In some embodiments, the CBD consists of a sequence according to any one of SEQ ID NO: 166-223 or the CBD region of any one of SEQ ID NO: 108-165. In some embodiments, the CBD comprises a sequence according to any one of SEQ ID NO: 166-223 or the CBD region of any one of SEQ ID NO: 108-165. In some embodiments, the CBD has at least 80, 81, 82, 83, 84, 85, 86, 87, 88, 89, 90, 91, 92, 93, 94, 95, 96, 97, 98, or 99% identity with a sequence according to any one of SEQ ID NO: 166-223 or the CBD region of any one of SEQ ID NO: 108-165. In some embodiments, the CBD differs by 1, 2, 3, 4, 5, 6, 7, 8, 9, 10, 11, 12, 13, 14, or 15 amino acids from a sequence according to any one of SEQ ID NO: 166-223 or the CBD region of any one of SEQ ID NO: 108-165.

In some embodiments, a recombinant protein of the disclosure comprises a CW_7 sequence from any one of the CPL-designated proteins exemplified in the Examples herein. In some embodiments, the recombinant protein comprises a CW_7 sequence comprised by any one of SEQ ID NO: 166-223 or the CBD region of any one of SEQ ID NO: 108-165. In some embodiments, the recombinant protein comprises a CW_7 sequence contained in any one of any one of SEQ ID NO: 166-223 or the CBD region of any one of SEQ ID NO: 108-165. In some embodiments, the recombinant protein comprises a CW_7 sequence having at least 40, 45, 50, 55, 60, 65, 70, 75, 80, 85, 90, or 95% identity with a CW_7 sequence comprised by any one of SEQ ID NO: 166-223 or the CBD region of any one of SEQ ID NO: 108-165. In some embodiments, the recombinant protein comprises a CW_7 sequence having at least 80, 81, 82, 83, 84, 85, 86, 87, 88, 89, 90, 91, 92, 93, 94, 95, 96, 97, 98, or 99% identity with a CW_7 sequence comprised by any one of SEQ ID NO: 166-223 or the CBD region of any one of SEQ ID NO: 108-165. In some embodiments, the CW_7 sequence differs by 1, 2, 3, 4, 5, 6, 7, 8, 9, 10, 11, 12, 13, 14, or 15 amino acids from a CW_7 sequence comprised by any one of SEQ ID NO: 166-223 or the CBD region of any one of SEQ ID NO: 108-165.

In some embodiments, a recombinant protein of the disclosure comprises a CW_7 CBD from the family of proteins comprising CW_7 CBDs disclosed herein. In some embodiments, the recombinant protein comprises a CW_7 CBD comprised by a sequence according to any one of SEQ ID NO: 282-2938. In some embodiments, the recombinant protein comprises the CBD contained in any one of SEQ ID NO: 282-2938. In some embodiments, the recombinant protein comprises a CBD having at least 40, 45, 50, 55, 60, 65, 70, 75, 80, 85, 90, or 95% identity with the CBD comprised by a sequence according to any one of SEQ ID NO: 282-2938. In some embodiments, the recombinant protein comprises a CBD having at least 80, 81, 82, 83, 84, 85, 86, 87, 88, 89, 90, 91, 92, 93, 94, 95, 96, 97, 98, or 99% identity with the CBD comprised by a sequence according to any one of SEQ ID NO: 282-2938. In some embodiments, the CBD sequence differs by 1, 2, 3, 4, 5, 6, 7, 8, 9, 10, 11, 12, 13, 14, or 15 amino acids from the CBD sequence comprised by a sequence according to any one of SEQ ID NO: 282-2938.

In some embodiments, a recombinant protein of the disclosure comprises a CW_7 sequence from the family of proteins comprising CW_7 sequences disclosed herein. In some embodiments, the recombinant protein comprises a CW_7 sequence comprised by a sequence according to any one of SEQ ID NO: 282-2938. In some embodiments, the recombinant protein comprises a CW_7 sequence contained in any one of SEQ ID NO: 282-2938. In some embodiments, the recombinant protein comprises a CW_7 sequence having at least 40, 45, 50, 55, 60, 65, 70, 75, 80, 85, 90, or 95% identity with a CW_7 sequence comprised by a sequence according to any one of SEQ ID NO: 282-2938. In some embodiments, the recombinant protein comprises a CW_7 sequence having at least 80, 81, 82, 83, 84, 85, 86, 87, 88, 89, 90, 91, 92, 93, 94, 95, 96, 97, 98, or 99% identity with a CW_7 sequence comprised by a sequence according to any one of SEQ ID NO: 282-2938. In some embodiments, the CW_7 sequence differs by 1, 2, 3, 4, 5, 6, 7, 8, 9, 10, 11, 12, 13, 14, or 15 amino acids from a CW_7 sequence comprised by a sequence according to any one of SEQ ID NO: 282-2938.

In some embodiments, a recombinant protein of the disclosure comprises a CW_7 CBD from the family of proteins comprising CW_7 CBDs disclosed herein. In some embodiments, the recombinant protein comprises a CW_7 CBD comprised by a sequence in Table 7. In some embodiments, the recombinant protein comprises the CBD contained in any one of the sequences in Table 7. In some embodiments, the recombinant protein comprises a CBD having at least 40, 45, 50, 55, 60, 65, 70, 75, 80, 85, 90, or 95% identity with the CBD comprised by a sequence in Table 7. In some embodiments, the recombinant protein comprises a CBD having at least 80, 81, 82, 83, 84, 85, 86, 87, 88, 89, 90, 91, 92, 93, 94, 95, 96, 97, 98, or 99% identity with the CBD comprised by a sequence in Table 7. In some embodiments, the CBD sequence differs by 1, 2, 3, 4, 5, 6, 7, 8, 9, 10, 11, 12, 13, 14, or 15 amino acids from the CBD sequence comprised by a sequence in Table 7.

In some embodiments, a recombinant protein of the disclosure comprises a CW_7 sequence from the family of proteins comprising CW_7 sequences disclosed herein. In some embodiments, the recombinant protein comprises a CW_7 sequence comprised by a sequence in Table 7. In some embodiments, the recombinant protein comprises a CW_7 sequence contained by a sequence in Table 7. In some embodiments, the recombinant protein comprises a CW_7 sequence having at least 40, 45, 50, 55, 60, 65, 70, 75, 80, 85, 90, or 95% identity with a CW_7 sequence comprised by a sequence in Table 7. In some embodiments, the recombinant protein comprises a CW_7 sequence having at least 80, 81, 82, 83, 84, 85, 86, 87, 88, 89, 90, 91, 92, 93, 94, 95, 96, 97, 98, or 99% identity with a CW_7 sequence comprised by a sequence in Table 7. In some embodiments, the CW_7 sequence differs by 1, 2, 3, 4, 5, 6, 7, 8, 9, 10, 11, 12, 13, 14, or 15 amino acids from a CW_7 sequence comprised by a sequence in Table 7.

In some embodiments, a recombinant protein of the disclosure comprises 1 CBD. In some embodiments, a recombinant protein of the disclosure comprises more than one CBD. In some embodiments, a recombinant protein of the disclosure comprises 2 CBDs. In some embodiments, a recombinant protein of the disclosure comprises 3, 4, 5, 6, 7, 8, 9, or 10 CBDs.

In some embodiments, a recombinant protein of the disclosure comprises 1 CW_7 sequence. In some embodiments, a recombinant protein of the disclosure comprises more than one CW_7 sequence. In some embodiments, a recombinant protein of the disclosure comprises 2 CW_7 sequences. In some embodiments, a recombinant protein of the disclosure comprises 3, 4, 5, 6, 7, 8, 9, or 10 CW_7 sequences.

In some embodiments, a recombinant protein of the disclosure comprises a CBD comprising a CW_7 sequence having the CW_7-21 motif (SEQ ID NO: 2940). In some embodiments, a recombinant protein of the disclosure comprises a CW_7 sequence having the CW_7-21 motif (SEQ ID NO: 2940). In some embodiments, the CW_7 sequence has the CW_7-21 motif (SEQ ID NO: 2940) and has at least 40, 45, 50, 55, 60, 65, 70, 75, 80, 85, 90, 95, 96, 97, 98, or 99% identity to the CLB2 CW_7 repeat. In some embodiments, the CW_7 sequence has the CW_7-21 motif (SEQ ID NO: 2940) and has at least 43% or at least 58% identity to the CLB2 CW_7 repeat. In some embodiments, the CW_7 sequence has the CW_7-21 motif (SEQ ID NO: 2940) and differs from the CLB2 CW_7 repeat by 1, 2, 3, 4, 5, 6, 7, 8, 9, 10, 11, 12, 13, 14, 15, 16, 17, 18, 19, 20, or 21 amino acids.

In some embodiments, a recombinant protein of the disclosure comprises a CBD comprising a CW_7 sequence having the CW_7-19 motif (SEQ ID NO: 2941). In some embodiments, a recombinant protein of the disclosure comprises a CW_7 sequence having the CW_7-19 motif (SEQ ID NO: 2941). In some embodiments, the CW_7 sequence has the CW_7-19 motif (SEQ ID NO 2941) and has at least 40, 45, 50, 55, 60, 65, 70, 75, 80, 85, 90, 95, 96, 97, 98, or 991 identity to the CLB2 CW_7 repeat. In some embodiments, the CW_7 sequence has the CW_7-19 motif (SEQ ID NO: 2941) and has at least 43% or at least 58% identity to the CLB32 CW_7 repeat. In some embodiments, the CW_7 sequence has the CW_7-19 motif (SEQ ID NO: 2941) and differs from the CLB32 CW_7 repeat by 1, 2, 3, 4, 5, 6, 7, 8, 9, 10, 11, 12, 13, 14, 15, 16, 17, 18, 19, 20, or 21 amino acids.

TABLE 7

CW_7 repeat-containing protein sequences and sequence identity to CLB2 CW_7.

| GenBank | SEQ | ID % |
|---|---|---|
| ALT38678.1 | 282 | 100 |
| MCD1109535.1 | 283 | 100 |
| MES6262332.1 | 284 | 100 |
| MES6899268.1 | 285 | 100 |
| MES7343073.1 | 286 | 100 |
| MES7636639.1 | 287 | 100 |
| MES8928379.1 | 288 | 100 |
| TLG05051.1 | 289 | 100 |
| WP_002519882.1 | 290 | 100 |
| WP_002535464.1 | 291 | 100 |
| WP_008598644.1 | 292 | 100 |
| WP_235694824.1 | 293 | 100 |
| WP_236891855.1 | 294 | 100 |
| WP_254926916.1 | 295 | 100 |
| WP_255024679.1 | 296 | 100 |
| WP_304161512.1 | 297 | 100 |
| HAT6583124.1 | 298 | 89.5 |
| WP_239663653.1 | 299 | 89.5 |
| WP_240927088.1 | 300 | 89.5 |
| CAB0517890.1 | 301 | 89.5 |
| HAT1491020.1 | 302 | 89.5 |
| HAT6436788.1 | 303 | 89.5 |
| HCG2965566.1 | 304 | 89.5 |
| KDS92380.1 | 305 | 89.5 |
| MCI6532281.1 | 306 | 89.5 |
| MDK7181277.1 | 307 | 89.5 |
| MDO5722416.1 | 308 | 89.5 |
| RKX02296.1 | 309 | 89.5 |
| WP_013888915.1 | 310 | 89.5 |
| WP_015583338.1 | 311 | 89.5 |

TABLE 7-continued

CW_7 repeat-containing protein sequences and sequence identity to CLB2 CW_7.

| GenBank | SEQ | ID % |
|---|---|---|
| WP_016455226.1 | 312 | 89.5 |
| WP_025296038.1 | 313 | 89.5 |
| WP_028821773.1 | 314 | 89.5 |
| WP_049157417.1 | 315 | 89.5 |
| WP_060797830.1 | 316 | 89.5 |
| WP_065415355.1 | 317 | 89.5 |
| WP_070491102.1 | 318 | 89.5 |
| WP_071345796.1 | 319 | 89.5 |
| WP_092101380.1 | 320 | 89.5 |
| WP_101630683.1 | 321 | 89.5 |
| WP_158382059.1 | 322 | 89.5 |
| WP_169762692.1 | 323 | 89.5 |
| WP_197551992.1 | 324 | 89.5 |
| WP_201771333.1 | 325 | 89.5 |
| WP_204398955.1 | 326 | 89.5 |
| WP_240628810.1 | 327 | 89.5 |
| WP_253254962.1 | 328 | 89.5 |
| WP_256881555.1 | 329 | 89.5 |
| WP_278972212.1 | 330 | 89.5 |
| WP_291499654.1 | 331 | 89.5 |
| WP_306496136.1 | 332 | 89.5 |
| WP_307014028.1 | 333 | 89.5 |
| WP_311519246.1 | 334 | 89.5 |
| WP_317586632.1 | 335 | 89.5 |
| WP_332106481.1 | 336 | 89.5 |
| WP_334353377.1 | 337 | 89.5 |
| WZJ88807.1 | 338 | 89.5 |
| WP_234457481.1 | 339 | 89.2 |
| WP_234458146.1 | 340 | 89.2 |
| WP_238996146.1 | 341 | 89.2 |
| MCT1709611.1 | 342 | 86.8 |
| MDK8532691.1 | 343 | 86.8 |
| WP_244268667.1 | 344 | 86.8 |
| CAB0561870.1 | 345 | 86.8 |
| CAB0573975.1 | 346 | 86.8 |
| CAB0853767.1 | 347 | 86.8 |
| CAB1016170.1 | 348 | 86.8 |
| CRH60380.1 | 349 | 86.8 |
| EFU82458.1 | 350 | 86.8 |
| HAT1145999.1 | 351 | 86.8 |
| HAT1171169.1 | 352 | 86.8 |
| HAT1197533.1 | 353 | 86.8 |
| HAT1428302.1 | 354 | 86.8 |
| HAT6437209.1 | 355 | 86.8 |
| MCI6574417.1 | 356 | 86.8 |
| MCQ9371168.1 | 357 | 86.8 |
| MDD7384156.1 | 358 | 86.8 |
| MDK8663827.1 | 359 | 86.8 |
| MDR6938515.1 | 360 | 86.8 |
| MDU1353073.1 | 361 | 86.8 |
| MDU1522419.1 | 362 | 86.8 |
| MDU7484863.1 | 363 | 86.8 |
| MDY5273730.1 | 364 | 86.8 |
| SPT54212.1 | 365 | 86.8 |
| WP_004007218.1 | 366 | 86.8 |
| WP_007000824.1 | 367 | 86.8 |
| WP_013888240.1 | 368 | 86.8 |
| WP_024330609.1 | 369 | 86.8 |
| WP_028822236.1 | 370 | 86.8 |
| WP_034652719.1 | 371 | 86.8 |
| WP_038604127.1 | 372 | 86.8 |
| WP_049619209.1 | 373 | 86.8 |
| WP_070448229.1 | 374 | 86.8 |
| WP_070544612.1 | 375 | 86.8 |
| WP_070816420.1 | 376 | 86.8 |
| WP_071128892.1 | 377 | 86.8 |
| WP_073717436.1 | 378 | 86.8 |
| WP_087453585.1 | 379 | 86.8 |
| WP_099720846.1 | 380 | 86.8 |
| WP_101634554.1 | 381 | 86.8 |
| WP_102217290.1 | 382 | 86.8 |
| WP_126416900.1 | 383 | 86.8 |
| WP_129864718.1 | 384 | 86.8 |
| WP_134316353.1 | 385 | 86.8 |
| WP_154545415.1 | 386 | 86.8 |
| WP_196974892.1 | 387 | 86.8 |
| WP_196982820.1 | 388 | 86.8 |
| WP_197553691.1 | 389 | 86.8 |
| WP_201517949.1 | 390 | 86.8 |
| WP_201613418.1 | 391 | 86.8 |
| WP_201806563.1 | 392 | 86.8 |
| WP_221187359.1 | 393 | 86.8 |
| WP_232751616.1 | 394 | 86.8 |
| WP_272707364.1 | 395 | 86.8 |
| WP_278012690.1 | 396 | 86.8 |
| WP_278611638.1 | 397 | 86.8 |
| WP_284827109.1 | 398 | 86.8 |
| WP_285112029.1 | 399 | 86.8 |
| WP_306496060.1 | 400 | 86.8 |
| WP_309956151.1 | 401 | 86.8 |
| WP_313274597.1 | 402 | 86.8 |
| WP_332107270.1 | 403 | 86.8 |
| WP_342675009.1 | 404 | 86.8 |
| WP_353061657.1 | 405 | 86.8 |
| WP_353065943.1 | 406 | 86.8 |
| WP_367249073.1 | 407 | 86.8 |
| WP_367263310.1 | 408 | 86.8 |
| WP_367266795.1 | 409 | 86.8 |
| WP_87453585.1 | 410 | 86.8 |
| WP_144744155.1 | 411 | 86.7 |
| MDK6900427.1 | 412 | 84.2 |
| MDK7340938.1 | 413 | 84.2 |
| MDK8804557.1 | 414 | 84.2 |
| PMC93990.1 | 415 | 84.2 |
| CAB0855742.1 | 416 | 84.2 |
| GAA0209635.1 | 417 | 84.2 |
| HAT1275965.1 | 418 | 84.2 |
| HAT1320501.1 | 419 | 84.2 |
| HAT1420995.1 | 420 | 84.2 |
| HJG29905.1 | 421 | 84.2 |
| MBS6101077.1 | 422 | 84.2 |
| MBS6620458.1 | 423 | 84.2 |
| MCI6205518.1 | 424 | 84.2 |
| MCI7552202.1 | 425 | 84.2 |
| MDD7505539.1 | 426 | 84.2 |
| MDE1643196.1 | 427 | 84.2 |
| MEN8963084.1 | 428 | 84.2 |
| OFQ56130.1 | 429 | 84.2 |
| PXY12082.1 | 430 | 84.2 |
| WP_005295621.1 | 431 | 84.2 |
| WP_014320292.1 | 432 | 84.2 |
| WP_024110547.1 | 433 | 84.2 |
| WP_025252126.1 | 434 | 84.2 |
| WP_034370666.1 | 435 | 84.2 |
| WP_034652730.1 | 436 | 84.2 |
| WP_038606893.1 | 437 | 84.2 |
| WP_048707924.1 | 438 | 84.2 |
| WP_070464947.1 | 439 | 84.2 |
| WP_100622299.1 | 440 | 84.2 |
| WP_101628633.1 | 441 | 84.2 |
| WP_101679291.1 | 442 | 84.2 |
| WP_102216815.1 | 443 | 84.2 |
| WP_122821163.1 | 444 | 84.2 |
| WP_193326978.1 | 445 | 84.2 |
| WP_197550925.1 | 446 | 84.2 |
| WP_219585294.1 | 447 | 84.2 |
| WP_239541478.1 | 448 | 84.2 |
| WP_246816308.1 | 449 | 84.2 |
| WP_246818655.1 | 450 | 84.2 |
| WP_253254959.1 | 451 | 84.2 |
| WP_253255071.1 | 452 | 84.2 |
| WP_256885595.1 | 453 | 84.2 |
| WP_263466925.1 | 454 | 84.2 |
| WP_263478195.1 | 455 | 84.2 |
| WP_274734577.1 | 456 | 84.2 |
| WP_274735440.1 | 457 | 84.2 |
| WP_277035150.1 | 458 | 84.2 |
| WP_284896939.1 | 459 | 84.2 |
| WP_284925209.1 | 460 | 84.2 |
| WP_285347112.1 | 461 | 84.2 |

TABLE 7-continued

CW_7 repeat-containing protein sequences
and sequence identity to CLB2 CW_7.

| GenBank | SEQ | ID % |
|---|---|---|
| WP_285371671.1 | 462 | 84.2 |
| WP_289827642.1 | 463 | 84.2 |
| WP_291461635.1 | 464 | 84.2 |
| WP_307738025.1 | 465 | 84.2 |
| WP_311497467.1 | 466 | 84.2 |
| WP_311586796.1 | 467 | 84.2 |
| WP_316280109.1 | 468 | 84.2 |
| WP_320764396.1 | 469 | 84.2 |
| WP_342683263.1 | 470 | 84.2 |
| WP_346674736.1 | 471 | 84.2 |
| WP_366965808.1 | 472 | 84.2 |
| WP_367266299.1 | 473 | 84.2 |
| ERH14802.1 | 474 | 81.6 |
| HIY51284.1 | 475 | 81.6 |
| KTF03634.1 | 476 | 81.6 |
| MBS4941952.1 | 477 | 81.6 |
| MBS6276004.1 | 478 | 81.6 |
| MBS6365653.1 | 479 | 81.6 |
| MBS6934773.1 | 480 | 81.6 |
| MDD5800782.1 | 481 | 81.6 |
| MDD6565536.1 | 482 | 81.6 |
| MDK8300961.1 | 483 | 81.6 |
| MDU1351097.1 | 484 | 81.6 |
| MDU2312762.1 | 485 | 81.6 |
| MDU5247738.1 | 486 | 81.6 |
| MED9961294.1 | 487 | 81.6 |
| WIK88022.1 | 488 | 81.6 |
| WP_004007598.1 | 489 | 81.6 |
| WP_004009149.1 | 490 | 81.6 |
| WP_006680348.1 | 491 | 81.6 |
| WP_007000727.1 | 492 | 81.6 |
| WP_022865293.1 | 493 | 81.6 |
| WP_024058359.1 | 494 | 81.6 |
| WP_070726928.1 | 495 | 81.6 |
| WP_071128441.1 | 496 | 81.6 |
| WP_071129517.1 | 497 | 81.6 |
| WP_072510112.1 | 498 | 81.6 |
| WP_086414274.1 | 499 | 81.6 |
| WP_087186594.1 | 500 | 81.6 |
| WP_087201200.1 | 501 | 81.6 |
| WP_087315485.1 | 502 | 81.6 |
| WP_102184077.1 | 503 | 81.6 |
| WP_165315851.1 | 504 | 81.6 |
| WP_166683304.1 | 505 | 81.6 |
| WP_193326349.1 | 506 | 81.6 |
| WP_204212539.1 | 507 | 81.6 |
| WP_204559735.1 | 508 | 81.6 |
| WP_204880317.1 | 509 | 81.6 |
| WP_218957875.1 | 510 | 81.6 |
| WP_227909790.1 | 511 | 81.6 |
| WP_239181537.1 | 512 | 81.6 |
| WP_252673749.1 | 513 | 81.6 |
| WP_264371188.1 | 514 | 81.6 |
| WP_270772239.1 | 515 | 81.6 |
| WP_276869678.1 | 516 | 81.6 |
| WP_285084311.1 | 517 | 81.6 |
| WP_285444565.1 | 518 | 81.6 |
| WP_285470750.1 | 519 | 81.6 |
| WP_287058228.1 | 520 | 81.6 |
| WP_288335642.1 | 521 | 81.6 |
| WP_288336691.1 | 522 | 81.6 |
| WP_288738045.1 | 523 | 81.6 |
| WP_289826693.1 | 524 | 81.6 |
| WP_301586619.1 | 525 | 81.6 |
| WP_308516211.1 | 526 | 81.6 |
| WP_311588034.1 | 527 | 81.6 |
| WP_316077010.1 | 528 | 81.6 |
| WP_320755504.1 | 529 | 81.6 |
| WP_323456950.1 | 530 | 81.6 |
| WP_324249269.1 | 531 | 81.6 |
| WP_330029979.1 | 532 | 81.6 |
| WP_367263175.1 | 533 | 81.6 |
| MDM8289123.1 | 534 | 81.6 |
| MDM8289214.1 | 535 | 81.6 |
| SCH06965.1 | 536 | 81.6 |
| WP_253254875.1 | 537 | 81.6 |
| WP_275052423.1 | 538 | 81.6 |
| WP_316083719.1 | 539 | 80.0 |
| MBM7824673.1 | 540 | 79.3 |
| AOZ72034.1 | 541 | 79.0 |
| DAE38969.1 | 542 | 79.0 |
| DAF83770.1 | 543 | 79.0 |
| DAH27442.1 | 544 | 79.0 |
| DAM21410.1 | 545 | 79.0 |
| DAM24911.1 | 546 | 79.0 |
| DAQ44887.1 | 547 | 79.0 |
| DAR31986.1 | 548 | 79.0 |
| DAU07580.1 | 549 | 79.0 |
| DAX08694.1 | 550 | 79.0 |
| HJA28948.1 | 551 | 79.0 |
| HJA29771.1 | 552 | 79.0 |
| HJH43109.1 | 553 | 79.0 |
| MBM6953313.1 | 554 | 79.0 |
| MCH4084529.1 | 555 | 79.0 |
| MCI1933832.1 | 556 | 79.0 |
| MDD6693199.1 | 557 | 79.0 |
| MDR3777680.1 | 558 | 79.0 |
| MDU6662690.1 | 559 | 79.0 |
| MEE0310276.1 | 560 | 79.0 |
| QFG04694.1 | 561 | 79.0 |
| QNL30979.1 | 562 | 79.0 |
| RHD35880.1 | 563 | 79.0 |
| RRF89371.1 | 564 | 79.0 |
| UVG34591.1 | 565 | 79.0 |
| UVM90174.1 | 566 | 79.0 |
| UVY04019.1 | 567 | 79.0 |
| UWG22304.1 | 568 | 79.0 |
| UWI11321.1 | 569 | 79.0 |
| WP_003841933.1 | 570 | 79.0 |
| WP_060919922.1 | 571 | 79.0 |
| WP_073708844.1 | 572 | 79.0 |
| WP_087220826.1 | 573 | 79.0 |
| WP_087353727.1 | 574 | 79.0 |
| WP_158567694.1 | 575 | 79.0 |
| WP_204204740.1 | 576 | 79.0 |
| WP_204672929.1 | 577 | 79.0 |
| WP_206108987.1 | 578 | 79.0 |
| WP_214364869.1 | 579 | 79.0 |
| WP_235422776.1 | 580 | 79.0 |
| WP_235810848.1 | 581 | 79.0 |
| WP_236842337.1 | 582 | 79.0 |
| WP_274959455.1 | 583 | 79.0 |
| WP_288738164.1 | 584 | 79.0 |
| WP_296762242.1 | 585 | 79.0 |
| WP_296773940.1 | 586 | 79.0 |
| WP_303251645.1 | 587 | 79.0 |
| WP_311776999.1 | 588 | 79.0 |
| WP_346697391.1 | 589 | 79.0 |
| WP_349075738.1 | 590 | 79.0 |
| WP_367191929.1 | 591 | 79.0 |
| MBM6687374.1 | 592 | 78.9 |
| WP_278620445.1 | 593 | 78.9 |
| MDU0864496.1 | 594 | 78.1 |
| WP_012577862.1 | 595 | 77.8 |
| WP_025221589.1 | 596 | 77.8 |
| WP_052789112.1 | 597 | 77.8 |
| WP_234988952.1 | 598 | 77.8 |
| WP_236716372.1 | 599 | 77.8 |
| WP_274982763.1 | 600 | 77.8 |
| WP_283713660.1 | 601 | 77.8 |
| WP_340509866.1 | 602 | 77.8 |
| WP_258499797.1 | 603 | 77.1 |
| WP_262360601.1 | 604 | 77.1 |
| WP_367245872.1 | 605 | 77.1 |
| CVH78623.1 | 606 | 76.3 |
| DAE90129.1 | 607 | 76.3 |
| DAJ02646.1 | 608 | 76.3 |
| DAL62644.1 | 609 | 76.3 |
| DAO39398.1 | 610 | 76.3 |
| DAQ08365.1 | 611 | 76.3 |

TABLE 7-continued

CW_7 repeat-containing protein sequences and sequence identity to CLB2 CW_7.

| GenBank | SEQ | ID % |
|---|---|---|
| DAT85648.1 | 612 | 76.3 |
| DAU71552.1 | 613 | 76.3 |
| ETJ02050.1 | 614 | 76.3 |
| HOU67165.1 | 615 | 76.3 |
| MBP3885850.1 | 616 | 76.3 |
| MBQ3283982.1 | 617 | 76.3 |
| MBR3160977.1 | 618 | 76.3 |
| MBS5339596.1 | 619 | 76.3 |
| MCI6273107.1 | 620 | 76.3 |
| MDO4797292.1 | 621 | 76.3 |
| MED9896471.1 | 622 | 76.3 |
| MEE0150117.1 | 623 | 76.3 |
| MEE1202220.1 | 624 | 76.3 |
| MEE8722548.1 | 625 | 76.3 |
| MEE8722860.1 | 626 | 76.3 |
| OUO64324.1 | 627 | 76.3 |
| SPJ41463.1 | 628 | 76.3 |
| UVY20648.1 | 629 | 76.3 |
| UVY22418.1 | 630 | 76.3 |
| UVY41455.1 | 631 | 76.3 |
| UVY42807.1 | 632 | 76.3 |
| UVY62299.1 | 633 | 76.3 |
| WP_013189212.1 | 634 | 76.3 |
| WP_018340121.1 | 635 | 76.3 |
| WP_039171927.1 | 636 | 76.3 |
| WP_051417651.1 | 637 | 76.3 |
| WP_053793915.1 | 638 | 76.3 |
| WP_072374346.1 | 639 | 76.3 |
| WP_073712978.1 | 640 | 76.3 |
| WP_101454355.1 | 641 | 76.3 |
| WP_118239140.1 | 642 | 76.3 |
| WP_120358882.1 | 643 | 76.3 |
| WP_129868423.1 | 644 | 76.3 |
| WP_129887274.1 | 645 | 76.3 |
| WP_129905530.1 | 646 | 76.3 |
| WP_129913053.1 | 647 | 76.3 |
| WP_157005339.1 | 648 | 76.3 |
| WP_196326954.1 | 649 | 76.3 |
| WP_197695792.1 | 650 | 76.3 |
| WP_204877685.1 | 651 | 76.3 |
| WP_231234722.1 | 652 | 76.3 |
| WP_235001784.1 | 653 | 76.3 |
| WP_240833659.1 | 654 | 76.3 |
| WP_240834043.1 | 655 | 76.3 |
| WP_255463933.1 | 656 | 76.3 |
| WP_258340775.1 | 657 | 76.3 |
| WP_277035292.1 | 658 | 76.3 |
| WP_278787610.1 | 659 | 76.3 |
| WP_281511047.1 | 660 | 76.3 |
| WP_288734903.1 | 661 | 76.3 |
| WP_289606002.1 | 662 | 76.3 |
| WP_294379484.1 | 663 | 76.3 |
| WP_302011171.1 | 664 | 76.3 |
| WP_306718268.1 | 665 | 76.3 |
| WP_308652068.1 | 666 | 76.3 |
| WP_309957417.1 | 667 | 76.3 |
| WP_311167331.1 | 668 | 76.3 |
| WP_320756401.1 | 669 | 76.3 |
| WP_321050744.1 | 670 | 76.3 |
| WP_330045465.1 | 671 | 76.3 |
| WP_343006893.1 | 672 | 76.3 |
| WP_343283724.1 | 673 | 76.3 |
| WP_349091822.1 | 674 | 76.3 |
| MBS4998786.1 | 675 | 76.3 |
| MCW1069382.1 | 676 | 76.3 |
| VTX63007.1 | 677 | 76.3 |
| WP_256363451.1 | 678 | 76.3 |
| WP_297993492.1 | 679 | 76.3 |
| WP_330959005.1 | 680 | 76.0 |
| MDE6078888.1 | 681 | 75.0 |
| WP_071477988.1 | 682 | 75.0 |
| MBQ9954849.1 | 683 | 74.3 |
| QFP95395.1 | 684 | 74.3 |
| QPX62467.1 | 685 | 74.3 |
| WP_225841104.1 | 686 | 74.3 |
| WP_241157056.1 | 687 | 74.3 |
| WP_320678874.1 | 688 | 74.3 |
| YP_009603465.1 | 689 | 74.3 |
| MBM6776861.1 | 690 | 73.7 |
| DAG79896.1 | 691 | 73.7 |
| DAH93651.1 | 692 | 73.7 |
| DAH96130.1 | 693 | 73.7 |
| DAM79893.1 | 694 | 73.7 |
| MBP3884765.1 | 695 | 73.7 |
| MBR2684294.1 | 696 | 73.7 |
| MBR3313910.1 | 697 | 73.7 |
| MBR3383747.1 | 698 | 73.7 |
| MBU3995549.1 | 699 | 73.7 |
| MCI1963232.1 | 700 | 73.7 |
| MCI6772718.1 | 701 | 73.7 |
| MDY5585074.1 | 702 | 73.7 |
| OUO89971.1 | 703 | 73.7 |
| RGK64659.1 | 704 | 73.7 |
| WP_021725214.1 | 705 | 73.7 |
| WP_071164539.1 | 706 | 73.7 |
| WP_077597407.1 | 707 | 73.7 |
| WP_083443693.1 | 708 | 73.7 |
| WP_095507846.1 | 709 | 73.7 |
| WP_108726243.1 | 710 | 73.7 |
| WP_129914362.1 | 711 | 73.7 |
| WP_140396461.1 | 712 | 73.7 |
| WP_158551533.1 | 713 | 73.7 |
| WP_166078452.1 | 714 | 73.7 |
| WP_169769106.1 | 715 | 73.7 |
| WP_169770235.1 | 716 | 73.7 |
| WP_172119268.1 | 717 | 73.7 |
| WP_197695294.1 | 718 | 73.7 |
| WP_231204509.1 | 719 | 73.7 |
| WP_288766823.1 | 720 | 73.7 |
| WP_302799763.1 | 721 | 73.7 |
| WP_307389411.1 | 722 | 73.7 |
| WP_311553230.1 | 723 | 73.7 |
| WP_316076978.1 | 724 | 73.7 |
| WP_316114142.1 | 725 | 73.7 |
| WP_320756186.1 | 726 | 73.7 |
| WP_367258047.1 | 727 | 73.7 |
| MBR3159555.1 | 728 | 72.0 |
| MCC6107950.1 | 729 | 71.4 |
| WP_232335355.1 | 730 | 71.4 |
| WP_288517741.1 | 731 | 71.4 |
| WP_314841170.1 | 732 | 71.4 |
| WP_288439705.1 | 733 | 71.1 |
| BCQ03072.1 | 734 | 71.1 |
| DAF74911.1 | 735 | 71.1 |
| DAK03040.1 | 736 | 71.1 |
| GAA0830428.1 | 737 | 71.1 |
| HJF65141.1 | 738 | 71.1 |
| KAB1937510.1 | 739 | 71.1 |
| MBF0930954.1 | 740 | 71.1 |
| MBQ6650832.1 | 741 | 71.1 |
| MBR3160912.1 | 742 | 71.1 |
| MBR3226812.1 | 743 | 71.1 |
| MBR3314005.1 | 744 | 71.1 |
| MBR3315877.1 | 745 | 71.1 |
| MCH3926258.1 | 746 | 71.1 |
| MCH3943076.1 | 747 | 71.1 |
| MCH3967202.1 | 748 | 71.1 |
| MCH4179945.1 | 749 | 71.1 |
| MCI6574112.1 | 750 | 71.1 |
| MDD3485675.1 | 751 | 71.1 |
| MDD5894634.1 | 752 | 71.1 |
| MDY5854438.1 | 753 | 71.1 |
| OCA93596.1 | 754 | 71.1 |
| OUN44218.1 | 755 | 71.1 |
| QQM68406.1 | 756 | 71.1 |
| RDB69432.1 | 757 | 71.1 |
| RXZ54872.1 | 758 | 71.1 |
| WP_026645545.1 | 759 | 71.1 |
| WP_081929442.1 | 760 | 71.1 |
| WP_083078413.1 | 761 | 71.1 |

TABLE 7-continued

CW_7 repeat-containing protein sequences and sequence identity to CLB2 CW_7.

| GenBank | SEQ | ID % |
|---|---|---|
| WP_085382352.1 | 762 | 71.1 |
| WP_087431060.1 | 763 | 71.1 |
| WP_095615304.1 | 764 | 71.1 |
| WP_099333256.1 | 765 | 71.1 |
| WP_099721457.1 | 766 | 71.1 |
| WP_101930602.1 | 767 | 71.1 |
| WP_102166064.1 | 768 | 71.1 |
| WP_114950125.1 | 769 | 71.1 |
| WP_161566699.1 | 770 | 71.1 |
| WP_197691245.1 | 771 | 71.1 |
| WP_204206713.1 | 772 | 71.1 |
| WP_206214603.1 | 773 | 71.1 |
| WP_211309516.1 | 774 | 71.1 |
| WP_221269321.1 | 775 | 71.1 |
| WP_231205335.1 | 776 | 71.1 |
| WP_234737297.1 | 777 | 71.1 |
| WP_257060362.1 | 778 | 71.1 |
| WP_257098767.1 | 779 | 71.1 |
| WP_270573768.1 | 780 | 71.1 |
| WP_273396550.1 | 781 | 71.1 |
| WP_273398208.1 | 782 | 71.1 |
| WP_276766181.1 | 783 | 71.1 |
| WP_285371490.1 | 784 | 71.1 |
| WP_294641980.1 | 785 | 71.1 |
| WP_329740163.1 | 786 | 71.1 |
| WP_347018137.1 | 787 | 71.1 |
| WP_353065929.1 | 788 | 71.1 |
| WP_353936116.1 | 789 | 71.1 |
| WP_367247011.1 | 790 | 71.1 |
| WP_021626552.1 | 791 | 71.0 |
| WP_291237374.1 | 792 | 71.0 |
| ERI05436.1 | 793 | 71.0 |
| ASR83301.1 | 794 | 70.3 |
| MEE8759108.1 | 795 | 70.3 |
| WP_131203990.1 | 796 | 70.3 |
| WP_195403441.1 | 797 | 70.3 |
| WP_150380808.1 | 798 | 69.4 |
| WZJ61236.1 | 799 | 69.4 |
| MDY5370263.1 | 800 | 69.2 |
| WP_094391330.1 | 801 | 69.2 |
| MDU4970728.1 | 802 | 69.2 |
| WP_002563352.1 | 803 | 69.2 |
| WP_275052505.1 | 804 | 68.6 |
| WP_081111191.1 | 805 | 68.6 |
| MBM6868472.1 | 806 | 68.4 |
| MCG4618262.1 | 807 | 68.4 |
| CAG9066035.1 | 808 | 68.4 |
| DAO21151.1 | 809 | 68.4 |
| DAZ27822.1 | 810 | 68.4 |
| DAZ80103.1 | 811 | 68.4 |
| KAB5616903.1 | 812 | 68.4 |
| MBH8616716.1 | 813 | 68.4 |
| MBQ9005563.1 | 814 | 68.4 |
| MDU4244491.1 | 815 | 68.4 |
| MDU5247007.1 | 816 | 68.4 |
| MDU5311827.1 | 817 | 68.4 |
| MDU5317220.1 | 818 | 68.4 |
| QFG09299.1 | 819 | 68.4 |
| QFG09714.1 | 820 | 68.4 |
| QFG14375.1 | 821 | 68.4 |
| QRI58918.1 | 822 | 68.4 |
| WP_003839536.1 | 823 | 68.4 |
| WP_014760674.1 | 824 | 68.4 |
| WP_024058694.1 | 825 | 68.4 |
| WP_033520074.1 | 826 | 68.4 |
| WP_052814115.1 | 827 | 68.4 |
| WP_065457245.1 | 828 | 68.4 |
| WP_084620827.1 | 829 | 68.4 |
| WP_101397356.1 | 830 | 68.4 |
| WP_101673666.1 | 831 | 68.4 |
| WP_118238945.1 | 832 | 68.4 |
| WP_129869804.1 | 833 | 68.4 |
| WP_129901458.1 | 834 | 68.4 |
| WP_129966908.1 | 835 | 68.4 |
| WP_131223742.1 | 836 | 68.4 |
| WP_131294595.1 | 837 | 68.4 |
| WP_167801519.1 | 838 | 68.4 |
| WP_196321401.1 | 839 | 68.4 |
| WP_204562218.1 | 840 | 68.4 |
| WP_206215061.1 | 841 | 68.4 |
| WP_228369686.1 | 842 | 68.4 |
| WP_231235716.1 | 843 | 68.4 |
| WP_238128205.1 | 844 | 68.4 |
| WP_239512813.1 | 845 | 68.4 |
| WP_242358332.1 | 846 | 68.4 |
| WP_278611176.1 | 847 | 68.4 |
| WP_288336440.1 | 848 | 68.4 |
| WP_288704103.1 | 849 | 68.4 |
| WP_290368091.1 | 850 | 68.4 |
| WP_298579913.1 | 851 | 68.4 |
| WP_302476469.1 | 852 | 68.4 |
| WP_320754788.1 | 853 | 68.4 |
| WP_320759177.1 | 854 | 68.4 |
| WP_347889375.1 | 855 | 68.4 |
| WP_367200856.1 | 856 | 68.4 |
| XCB30969.1 | 857 | 68.4 |
| MDE5808296.1 | 858 | 67.9 |
| MDE6027283.1 | 859 | 67.9 |
| MDO4973172.1 | 860 | 67.7 |
| MBD5311228.1 | 861 | 67.7 |
| MDE5643225.1 | 862 | 67.7 |
| MDE6670541.1 | 863 | 67.7 |
| MDY5956946.1 | 864 | 67.7 |
| MDY5957234.1 | 865 | 67.7 |
| WP_300108134.1 | 866 | 67.7 |
| WP_320875837.1 | 867 | 67.7 |
| WP_320881686.1 | 868 | 67.7 |
| DAU53159.1 | 869 | 67.7 |
| DAL75307.1 | 870 | 67.6 |
| MDU3738515.1 | 871 | 67.6 |
| WP_101628961.1 | 872 | 67.6 |
| WP_131305949.1 | 873 | 67.6 |
| WP_195549566.1 | 874 | 67.6 |
| MBR2558341.1 | 875 | 66.7 |
| WP_004835137.1 | 876 | 66.7 |
| WP_148466389.1 | 877 | 66.7 |
| WP_295149054.1 | 878 | 66.7 |
| WP_316131312.1 | 879 | 66.7 |
| WP_350446096.1 | 880 | 66.7 |
| WP_353746390.1 | 881 | 66.7 |
| WP_071415326.1 | 882 | 65.9 |
| DAL98440.1 | 883 | 65.8 |
| DAQ17303.1 | 884 | 65.8 |
| KAB5611598.1 | 885 | 65.8 |
| MBQ0159319.1 | 886 | 65.8 |
| MBR1689370.1 | 887 | 65.8 |
| MBS6345050.1 | 888 | 65.8 |
| MBS6401169.1 | 889 | 65.8 |
| MCH3961119.1 | 890 | 65.8 |
| MCI1344319.1 | 891 | 65.8 |
| MCI8753725.1 | 892 | 65.8 |
| MDO4391700.1 | 893 | 65.8 |
| MDU4287412.1 | 894 | 65.8 |
| MDY4471581.1 | 895 | 65.8 |
| MDY4719988.1 | 896 | 65.8 |
| MDY4947425.1 | 897 | 65.8 |
| MDY5002985.1 | 898 | 65.8 |
| MDY5809713.1 | 899 | 65.8 |
| MEO2302128.1 | 900 | 65.8 |
| MVN48724.1 | 901 | 65.8 |
| MVN54540.1 | 902 | 65.8 |
| OFR30555.1 | 903 | 65.8 |
| UWF80397.1 | 904 | 65.8 |
| WP_016455084.1 | 905 | 65.8 |
| WP_017767652.1 | 906 | 65.8 |
| WP_022865527.1 | 907 | 65.8 |
| WP_029691326.1 | 908 | 65.8 |
| WP_048349524.1 | 909 | 65.8 |
| WP_064468301.1 | 910 | 65.8 |
| WP_070664409.1 | 911 | 65.8 |

TABLE 7-continued

CW_7 repeat-containing protein sequences and sequence identity to CLB2 CW_7.

| GenBank | SEQ | ID % |
|---|---|---|
| WP_094689643.1 | 912 | 65.8 |
| WP_105302716.1 | 913 | 65.8 |
| WP_111835664.1 | 914 | 65.8 |
| WP_129853666.1 | 915 | 65.8 |
| WP_187323888.1 | 916 | 65.8 |
| WP_196322039.1 | 917 | 65.8 |
| WP_196716870.1 | 918 | 65.8 |
| WP_212927898.1 | 919 | 65.8 |
| WP_214373396.1 | 920 | 65.8 |
| WP_217952654.1 | 921 | 65.8 |
| WP_226814206.1 | 922 | 65.8 |
| WP_233187685.1 | 923 | 65.8 |
| WP_269801654.1 | 924 | 65.8 |
| WP_270416430.1 | 925 | 65.8 |
| WP_297152199.1 | 926 | 65.8 |
| WP_308806891.1 | 927 | 65.8 |
| WP_332309264.1 | 928 | 65.8 |
| WP_332309275.1 | 929 | 65.8 |
| WP_367246455.1 | 930 | 65.8 |
| DAS09555.1 | 931 | 65.7 |
| DAU44944.1 | 932 | 65.7 |
| MBO6229297.1 | 933 | 65.7 |
| MBS6611818.1 | 934 | 65.7 |
| UQS94678.1 | 935 | 65.7 |
| UVK58666.1 | 936 | 65.7 |
| UVK62826.1 | 937 | 65.7 |
| WNN94508.1 | 938 | 65.7 |
| WNT45387.1 | 939 | 65.7 |
| WP_321109965.1 | 940 | 65.7 |
| MDR2064222.1 | 941 | 65.6 |
| NLB86109.1 | 942 | 65.6 |
| MDE6562206.1 | 943 | 65.5 |
| DAV71436.1 | 944 | 64.9 |
| DAX88488.1 | 945 | 64.9 |
| WP_241513445.1 | 946 | 64.9 |
| WP_298648273.1 | 947 | 64.9 |
| WP_347014598.1 | 948 | 64.9 |
| WP_347017587.1 | 949 | 64.9 |
| YP_010749833.1 | 950 | 64.9 |
| YP_010750018.1 | 951 | 64.9 |
| YP_010750454.1 | 952 | 64.9 |
| YP_010750543.1 | 953 | 64.9 |
| MDE5876126.1 | 954 | 64.5 |
| MDE6098411.1 | 955 | 64.5 |
| MDK7734839.1 | 956 | 64.5 |
| CRH88545.1 | 957 | 64.1 |
| DAZ79371.1 | 958 | 64.1 |
| MDD7306634.1 | 959 | 64.1 |
| WP_108831516.1 | 960 | 64.1 |
| WP_316711815.1 | 961 | 64.1 |
| WP_316716122.1 | 962 | 64.1 |
| WP_290163399.1 | 963 | 63.9 |
| WP_321973189.1 | 964 | 63.9 |
| WP_322354807.1 | 965 | 63.9 |
| WP_332058111.1 | 966 | 63.9 |
| MCM1222971.1 | 967 | 63.6 |
| DAX21245.1 | 968 | 63.4 |
| DAG21365.1 | 969 | 63.4 |
| DAG38064.1 | 970 | 63.4 |
| DAQ11137.1 | 971 | 63.4 |
| DAQ74288.1 | 972 | 63.4 |
| DAV69797.1 | 973 | 63.4 |
| MBD8989282.1 | 974 | 63.4 |
| MBR7058092.1 | 975 | 63.4 |
| MBS4949125.1 | 976 | 63.4 |
| MCI5948801.1 | 977 | 63.4 |
| MCQ2455584.1 | 978 | 63.4 |
| MDO4397246.1 | 979 | 63.4 |
| MDU2202814.1 | 980 | 63.4 |
| MDU3153525.1 | 981 | 63.4 |
| WP_004815548.1 | 982 | 63.4 |
| WP_040398502.1 | 983 | 63.4 |
| WP_102198006.1 | 984 | 63.4 |
| WP_236784742.1 | 985 | 63.4 |
| WP_271190939.1 | 986 | 63.4 |
| WP_276876721.1 | 987 | 63.4 |
| WP_316125110.1 | 988 | 63.4 |
| WP_316259699.1 | 989 | 63.4 |
| DAE10185.1 | 990 | 63.2 |
| DAE37447.1 | 991 | 63.2 |
| DAP86395.1 | 992 | 63.2 |
| EFM41449.1 | 993 | 63.2 |
| HAP28934.1 | 994 | 63.2 |
| HEP3485709.1 | 995 | 63.2 |
| HEP3594365.1 | 996 | 63.2 |
| MBQ9001100.1 | 997 | 63.2 |
| MBR3224217.1 | 998 | 63.2 |
| MCH4205199.1 | 999 | 63.2 |
| MDE5633374.1 | 1000 | 63.2 |
| MEE0972498.1 | 1001 | 63.2 |
| QFG09112.1 | 1002 | 63.2 |
| RXE73511.1 | 1003 | 63.2 |
| WP_003843926.1 | 1004 | 63.2 |
| WP_043036829.1 | 1005 | 63.2 |
| WP_069996976.1 | 1006 | 63.2 |
| WP_070021810.1 | 1007 | 63.2 |
| WP_070043600.1 | 1008 | 63.2 |
| WP_077323271.1 | 1009 | 63.2 |
| WP_094726333.1 | 1010 | 63.2 |
| WP_105302986.1 | 1011 | 63.2 |
| WP_119875702.1 | 1012 | 63.2 |
| WP_160213661.1 | 1013 | 63.2 |
| WP_163583485.1 | 1014 | 63.2 |
| WP_166339669.1 | 1015 | 63.2 |
| WP_195920298.1 | 1016 | 63.2 |
| WP_196334987.1 | 1017 | 63.2 |
| WP_223355836.1 | 1018 | 63.2 |
| WP_264340631.1 | 1019 | 63.2 |
| WP_264340658.1 | 1020 | 63.2 |
| WP_285112198.1 | 1021 | 63.2 |
| WP_301356913.1 | 1022 | 63.2 |
| WP_305296540.1 | 1023 | 63.2 |
| YP_010749746.1 | 1024 | 63.2 |
| YP_010749926.1 | 1025 | 63.2 |
| KIS17957.1 | 1026 | 63.2 |
| WP_300954678.1 | 1027 | 63.0 |
| WP_270471910.1 | 1028 | 63.0 |
| DAE91224.1 | 1029 | 62.5 |
| DAM24539.1 | 1030 | 62.5 |
| DAP80735.1 | 1031 | 62.5 |
| DAY46996.1 | 1032 | 62.5 |
| MBD9043651.1 | 1033 | 62.5 |
| MCB0539258.1 | 1034 | 62.5 |
| MCI5982561.1 | 1035 | 62.5 |
| MDR1881842.1 | 1036 | 62.5 |
| MEE1347036.1 | 1037 | 62.5 |
| NLK93115.1 | 1038 | 62.5 |
| RHD34509.1 | 1039 | 62.5 |
| WP_256267913.1 | 1040 | 62.5 |
| WP_288518369.1 | 1041 | 62.5 |
| WP_303014023.1 | 1042 | 62.5 |
| WP_329993587.1 | 1043 | 62.5 |
| DAG78306.1 | 1044 | 62.2 |
| DAR99974.1 | 1045 | 62.2 |
| DAW92160.1 | 1046 | 62.2 |
| DAY92830.1 | 1047 | 62.2 |
| HEM3681644.1 | 1048 | 62.2 |
| UVX57188.1 | 1049 | 62.2 |
| WP_214358849.1 | 1050 | 62.2 |
| WP_226674200.1 | 1051 | 62.2 |
| WP_241513637.1 | 1052 | 62.2 |
| WP_293817352.1 | 1053 | 62.2 |
| MBR1792531.1 | 1054 | 62.1 |
| MDR0573062.1 | 1055 | 62.1 |
| KWZ98309.1 | 1056 | 61.5 |
| MDU2025612.1 | 1057 | 61.5 |
| MDU2710058.1 | 1058 | 61.5 |
| MDU6032175.1 | 1059 | 61.5 |
| MDY3119231.1 | 1060 | 61.5 |
| WP_002834858.1 | 1061 | 61.5 |

TABLE 7-continued

CW_7 repeat-containing protein sequences and sequence identity to CLB2 CW_7.

| GenBank | SEQ | ID % |
|---|---|---|
| WP_066130500.1 | 1062 | 61.5 |
| WP_071125805.1 | 1063 | 61.5 |
| WP_075659837.1 | 1064 | 61.5 |
| WP_094206257.1 | 1065 | 61.5 |
| WP_094208061.1 | 1066 | 61.5 |
| WP_131749276.1 | 1067 | 61.5 |
| WP_148466397.1 | 1068 | 61.5 |
| WP_273497912.1 | 1069 | 61.5 |
| WP_277219390.1 | 1070 | 61.5 |
| WP_285083715.1 | 1071 | 61.5 |
| WP_316258004.1 | 1072 | 61.5 |
| WP_316277261.1 | 1073 | 61.5 |
| WP_316536349.1 | 1074 | 61.5 |
| WP_349169999.1 | 1075 | 61.5 |
| WZE63394.1 | 1076 | 61.5 |
| MDE5655895.1 | 1077 | 61.3 |
| DAD93583.1 | 1078 | 61.1 |
| DAI70013.1 | 1079 | 61.1 |
| MBD5171685.1 | 1080 | 61.1 |
| MBD5323526.1 | 1081 | 61.1 |
| MBR4886392.1 | 1082 | 61.1 |
| MBS6101062.1 | 1083 | 61.1 |
| MCC8176492.1 | 1084 | 61.1 |
| WP_102218431.1 | 1085 | 61.1 |
| WP_135040546.1 | 1086 | 61.1 |
| WP_204458078.1 | 1087 | 61.1 |
| WP_211810791.1 | 1088 | 61.1 |
| WP_211820463.1 | 1089 | 61.1 |
| WP_297572425.1 | 1090 | 61.1 |
| WP_314699748.1 | 1091 | 61.1 |
| WP_315363016.1 | 1092 | 61.1 |
| WP_315582330.1 | 1093 | 61.1 |
| DAG35656.1 | 1094 | 61.0 |
| DAH42994.1 | 1095 | 61.0 |
| DAN42819.1 | 1096 | 61.0 |
| DAR58693.1 | 1097 | 61.0 |
| DAS75787.1 | 1098 | 61.0 |
| DAS80110.1 | 1099 | 61.0 |
| DAU24415.1 | 1100 | 61.0 |
| DAV78720.1 | 1101 | 61.0 |
| DAY24267.1 | 1102 | 61.0 |
| DAY92418.1 | 1103 | 61.0 |
| HEN0920928.1 | 1104 | 61.0 |
| HES5977255.1 | 1105 | 61.0 |
| KGF33253.1 | 1106 | 61.0 |
| KWZ97970.1 | 1107 | 61.0 |
| MCC9971120.1 | 1108 | 61.0 |
| MCX4357018.1 | 1109 | 61.0 |
| MDE6733460.1 | 1110 | 61.0 |
| MDU0946473.1 | 1111 | 61.0 |
| MDU6064502.1 | 1112 | 61.0 |
| MDY6062382.1 | 1113 | 61.0 |
| QBX15581.1 | 1114 | 61.0 |
| QQO40300.1 | 1115 | 61.0 |
| RGJ72596.1 | 1116 | 61.0 |
| WP_004817817.1 | 1117 | 61.0 |
| WP_020758810.1 | 1118 | 61.0 |
| WP_020760684.1 | 1119 | 61.0 |
| WP_028505417.1 | 1120 | 61.0 |
| WP_048782353.1 | 1121 | 61.0 |
| WP_049690569.1 | 1122 | 61.0 |
| WP_053942762.1 | 1123 | 61.0 |
| WP_058890964.1 | 1124 | 61.0 |
| WP_063633074.1 | 1125 | 61.0 |
| WP_065957164.1 | 1126 | 61.0 |
| WP_070584868.1 | 1127 | 61.0 |
| WP_076002731.1 | 1128 | 61.0 |
| WP_085875841.1 | 1129 | 61.0 |
| WP_116691955.1 | 1130 | 61.0 |
| WP_117625149.1 | 1131 | 61.0 |
| WP_150412426.1 | 1132 | 61.0 |
| WP_150891248.1 | 1133 | 61.0 |
| WP_156667719.1 | 1134 | 61.0 |
| WP_163104227.1 | 1135 | 61.0 |
| WP_206151972.1 | 1136 | 61.0 |
| WP_264347151.1 | 1137 | 61.0 |
| WP_271528891.1 | 1138 | 61.0 |
| WP_276771163.1 | 1139 | 61.0 |
| WP_278578613.1 | 1140 | 61.0 |
| WP_284346615.1 | 1141 | 61.0 |
| WP_303825152.1 | 1142 | 61.0 |
| WP_303886853.1 | 1143 | 61.0 |
| WP_306487063.1 | 1144 | 61.0 |
| WP_311370301.1 | 1145 | 61.0 |
| WP_311436783.1 | 1146 | 61.0 |
| WP_315027119.1 | 1147 | 61.0 |
| WP_316081316.1 | 1148 | 61.0 |
| WP_316083149.1 | 1149 | 61.0 |
| WP_349820259.1 | 1150 | 61.0 |
| DAO69701.1 | 1151 | 61.0 |
| MED5763440.1 | 1152 | 61.0 |
| WP_118750982.1 | 1153 | 61.0 |
| WP_150861031.1 | 1154 | 61.0 |
| QFG13613.1 | 1155 | 60.7 |
| DAZ27128.1 | 1156 | 60.6 |
| MBQ9658343.1 | 1157 | 60.6 |
| CDE95606.1 | 1158 | 60.5 |
| DAE07393.1 | 1159 | 60.5 |
| DAH51102.1 | 1160 | 60.5 |
| DAJ01481.1 | 1161 | 60.5 |
| DAN98945.1 | 1162 | 60.5 |
| DAO39897.1 | 1163 | 60.5 |
| DAQ97161.1 | 1164 | 60.5 |
| DAU96762.1 | 1165 | 60.5 |
| DAV93860.1 | 1166 | 60.5 |
| DAW58986.1 | 1167 | 60.5 |
| DAW64646.1 | 1168 | 60.5 |
| DAZ06134.1 | 1169 | 60.5 |
| HEL0787365.1 | 1170 | 60.5 |
| HEL1580504.1 | 1171 | 60.5 |
| HEL1588637.1 | 1172 | 60.5 |
| HEL1785799.1 | 1173 | 60.5 |
| HEL2261299.1 | 1174 | 60.5 |
| HEM3680527.1 | 1175 | 60.5 |
| HEM3695368.1 | 1176 | 60.5 |
| HEP4476158.1 | 1177 | 60.5 |
| HEP5759258.1 | 1178 | 60.5 |
| HEQ9431484.1 | 1179 | 60.5 |
| HEQ9463603.1 | 1180 | 60.5 |
| HIS39969.1 | 1181 | 60.5 |
| KAA6140981.1 | 1182 | 60.5 |
| KAB5910941.1 | 1183 | 60.5 |
| MBG9981762.1 | 1184 | 60.5 |
| MBM6747214.1 | 1185 | 60.5 |
| MBP3771575.1 | 1186 | 60.5 |
| MBR2258270.1 | 1187 | 60.5 |
| MBR3314243.1 | 1188 | 60.5 |
| MBT9645934.1 | 1189 | 60.5 |
| MCC9684219.1 | 1190 | 60.5 |
| MCC9697169.1 | 1191 | 60.5 |
| MCI5976192.1 | 1192 | 60.5 |
| MCI6713172.1 | 1193 | 60.5 |
| MCX4355861.1 | 1194 | 60.5 |
| MDE6928620.1 | 1195 | 60.5 |
| MDW8721211.1 | 1196 | 60.5 |
| MDY3797592.1 | 1197 | 60.5 |
| QBX23791.1 | 1198 | 60.5 |
| QFG08678.1 | 1199 | 60.5 |
| RGV16217.1 | 1200 | 60.5 |
| RHJ17266.1 | 1201 | 60.5 |
| RHP71026.1 | 1202 | 60.5 |
| RHU32963.1 | 1203 | 60.5 |
| UVY58840.1 | 1204 | 60.5 |
| UWD73207.1 | 1205 | 60.5 |
| UWF84366.1 | 1206 | 60.5 |
| UWH97680.1 | 1207 | 60.5 |
| WGH21693.1 | 1208 | 60.5 |
| WP_033499054.1 | 1209 | 60.5 |
| WP_043026720.1 | 1210 | 60.5 |
| WP_044760627.1 | 1211 | 60.5 |

TABLE 7-continued

CW_7 repeat-containing protein sequences and sequence identity to CLB2 CW_7.

| GenBank | SEQ | ID % |
|---|---|---|
| WP_075105316.1 | 1212 | 60.5 |
| WP_093649504.1 | 1213 | 60.5 |
| WP_099721625.1 | 1214 | 60.5 |
| WP_101541573.1 | 1215 | 60.5 |
| WP_115283083.1 | 1216 | 60.5 |
| WP_154052834.1 | 1217 | 60.5 |
| WP_164406171.1 | 1218 | 60.5 |
| WP_165737659.1 | 1219 | 60.5 |
| WP_174850419.1 | 1220 | 60.5 |
| WP_182438950.1 | 1221 | 60.5 |
| WP_190278465.1 | 1222 | 60.5 |
| WP_212973039.1 | 1223 | 60.5 |
| WP_215678720.1 | 1224 | 60.5 |
| WP_231148010.1 | 1225 | 60.5 |
| WP_231367239.1 | 1226 | 60.5 |
| WP_239459142.1 | 1227 | 60.5 |
| WP_242698100.1 | 1228 | 60.5 |
| WP_257384659.1 | 1229 | 60.5 |
| WP_259302491.1 | 1230 | 60.5 |
| WP_259328150.1 | 1231 | 60.5 |
| WP_259328953.1 | 1232 | 60.5 |
| WP_270202457.1 | 1233 | 60.5 |
| WP_270625927.1 | 1234 | 60.5 |
| WP_271718045.1 | 1235 | 60.5 |
| WP_282209729.1 | 1236 | 60.5 |
| WP_284790345.1 | 1237 | 60.5 |
| WP_301587153.1 | 1238 | 60.5 |
| WP_332058383.1 | 1239 | 60.5 |
| WP_336261417.1 | 1240 | 60.5 |
| WP_367256048.1 | 1241 | 60.5 |
| MBQ2316265.1 | 1242 | 60.5 |
| WP_078390735.1 | 1243 | 60.5 |
| WP_182426743.1 | 1244 | 60.5 |
| AYD87216.1 | 1245 | 60.0 |
| DAE60825.1 | 1246 | 60.0 |
| DAF33844.1 | 1247 | 60.0 |
| DAH53468.1 | 1248 | 60.0 |
| DAI57608.1 | 1249 | 60.0 |
| DAI85954.1 | 1250 | 60.0 |
| DAJ72724.1 | 1251 | 60.0 |
| DAJ84296.1 | 1252 | 60.0 |
| DAL31530.1 | 1253 | 60.0 |
| DAN17868.1 | 1254 | 60.0 |
| DAP36906.1 | 1255 | 60.0 |
| DAT94504.1 | 1256 | 60.0 |
| DAV66269.1 | 1257 | 60.0 |
| DAX28918.1 | 1258 | 60.0 |
| DAZ39095.1 | 1259 | 60.0 |
| DAZ43436.1 | 1260 | 60.0 |
| EDN82835.1 | 1261 | 60.0 |
| EPT97855.1 | 1262 | 60.0 |
| GDY96701.1 | 1263 | 60.0 |
| GDZ14048.1 | 1264 | 60.0 |
| HJI53419.1 | 1265 | 60.0 |
| KAB5913358.1 | 1266 | 60.0 |
| MBQ1440049.1 | 1267 | 60.0 |
| MBQ1440213.1 | 1268 | 60.0 |
| MBS5344990.1 | 1269 | 60.0 |
| MCX4364628.1 | 1270 | 60.0 |
| MDB0584235.1 | 1271 | 60.0 |
| MDB0584332.1 | 1272 | 60.0 |
| MDB1402780.1 | 1273 | 60.0 |
| MDG3146345.1 | 1274 | 60.0 |
| MDO4394948.1 | 1275 | 60.0 |
| MDO4873232.1 | 1276 | 60.0 |
| MDR3744106.1 | 1277 | 60.0 |
| MEO5392119.1 | 1278 | 60.0 |
| MEO5545186.1 | 1279 | 60.0 |
| OZG68262.1 | 1280 | 60.0 |
| PKY88156.1 | 1281 | 60.0 |
| RGY75950.1 | 1282 | 60.0 |
| RHL94559.1 | 1283 | 60.0 |
| WP_094636851.1 | 1284 | 60.0 |
| WP_106621505.1 | 1285 | 60.0 |
| WP_135156249.1 | 1286 | 60.0 |
| WP_138296803.1 | 1287 | 60.0 |
| WP_152026998.1 | 1288 | 60.0 |
| WP_155972593.1 | 1289 | 60.0 |
| WP_158087765.1 | 1290 | 60.0 |
| WP_162008473.1 | 1291 | 60.0 |
| WP_179141965.1 | 1292 | 60.0 |
| WP_182432327.1 | 1293 | 60.0 |
| WP_195247765.1 | 1294 | 60.0 |
| WP_198051789.1 | 1295 | 60.0 |
| WP_217063305.1 | 1296 | 60.0 |
| WP_223895965.1 | 1297 | 60.0 |
| WP_226562967.1 | 1298 | 60.0 |
| WP_226676390.1 | 1299 | 60.0 |
| WP_227990307.1 | 1300 | 60.0 |
| WP_229027019.1 | 1301 | 60.0 |
| WP_230456860.1 | 1302 | 60.0 |
| WP_240836407.1 | 1303 | 60.0 |
| WP_241157620.1 | 1304 | 60.0 |
| WP_257964118.1 | 1305 | 60.0 |
| WP_270301365.1 | 1306 | 60.0 |
| WP_270557813.1 | 1307 | 60.0 |
| WP_271718013.1 | 1308 | 60.0 |
| WP_271735398.1 | 1309 | 60.0 |
| WP_276610523.1 | 1310 | 60.0 |
| WP_300955093.1 | 1311 | 60.0 |
| WP_302691238.1 | 1312 | 60.0 |
| WP_346971473.1 | 1313 | 60.0 |
| WP_346974628.1 | 1314 | 60.0 |
| WP_347029834.1 | 1315 | 60.0 |
| WP_347309308.1 | 1316 | 60.0 |
| YP_009603377.1 | 1317 | 60.0 |
| DAE68824.1 | 1318 | 59.5 |
| DAE83464.1 | 1319 | 59.5 |
| DAL50846.1 | 1320 | 59.5 |
| DAL69393.1 | 1321 | 59.5 |
| DAM40440.1 | 1322 | 59.5 |
| DAO47211.1 | 1323 | 59.5 |
| DAV24095.1 | 1324 | 59.5 |
| DAW47376.1 | 1325 | 59.5 |
| MBT9823866.1 | 1326 | 59.5 |
| MBU9067560.1 | 1327 | 59.5 |
| MCZ4448492.1 | 1328 | 59.5 |
| MDN4192218.1 | 1329 | 59.5 |
| MDU4035230.1 | 1330 | 59.5 |
| PXY87351.1 | 1331 | 59.5 |
| QHJ78355.1 | 1332 | 59.5 |
| UAU37679.1 | 1333 | 59.5 |
| UVY26228.1 | 1334 | 59.5 |
| UWG12920.1 | 1335 | 59.5 |
| UWG28836.1 | 1336 | 59.5 |
| WP_025301165.1 | 1337 | 59.5 |
| WP_058101879.1 | 1338 | 59.5 |
| WP_058102379.1 | 1339 | 59.5 |
| WP_117656824.1 | 1340 | 59.5 |
| WP_171842699.1 | 1341 | 59.5 |
| WP_181415636.1 | 1342 | 59.5 |
| WP_223616784.1 | 1343 | 59.5 |
| WP_226598371.1 | 1344 | 59.5 |
| WP_227248116.1 | 1345 | 59.5 |
| WP_237973881.1 | 1346 | 59.5 |
| WP_269374407.1 | 1347 | 59.5 |
| WP_270198036.1 | 1348 | 59.5 |
| WP_288923530.1 | 1349 | 59.5 |
| WP_306172973.1 | 1350 | 59.5 |
| WP_347011742.1 | 1351 | 59.5 |
| WP_367304467.1 | 1352 | 59.5 |
| WP_252195685.1 | 1353 | 59.5 |
| DAN65483.1 | 1354 | 59.4 |
| MBS5527381.1 | 1355 | 59.4 |
| MDB0925878.1 | 1356 | 59.4 |
| MDD7150974.1 | 1357 | 59.4 |
| MEE1371684.1 | 1358 | 59.4 |
| WP_005651920.1 | 1359 | 59.4 |
| WP_016662242.1 | 1360 | 59.4 |
| WP_032944750.1 | 1361 | 59.4 |

TABLE 7-continued

CW_7 repeat-containing protein sequences and sequence identity to CLB2 CW_7.

| GenBank | SEQ | ID % |
|---|---|---|
| WP_055167641.1 | 1362 | 59.4 |
| WP_117907320.1 | 1363 | 59.4 |
| WP_117983990.1 | 1364 | 59.4 |
| WP_221734782.1 | 1365 | 59.4 |
| WP_234250675.1 | 1366 | 59.4 |
| WP_237464145.1 | 1367 | 59.4 |
| WP_308006913.1 | 1368 | 59.4 |
| WP_347502903.1 | 1369 | 59.4 |
| WP_349167250.1 | 1370 | 59.4 |
| UVX48964.1 | 1371 | 59.4 |
| WP_278698178.1 | 1372 | 59.4 |
| WP_304330030.1 | 1373 | 59.4 |
| MCI7239121.1 | 1374 | 59.0 |
| MDO4662903.1 | 1375 | 59.0 |
| MDU3805833.1 | 1376 | 59.0 |
| MDU5807467.1 | 1377 | 59.0 |
| MDU6792092.1 | 1378 | 59.0 |
| MDU7502579.1 | 1379 | 59.0 |
| MEE3451439.1 | 1380 | 59.0 |
| MEE3495404.1 | 1381 | 59.0 |
| WP_019117835.1 | 1382 | 59.0 |
| WP_019131806.1 | 1383 | 59.0 |
| WP_044565592.1 | 1384 | 59.0 |
| WP_049690785.1 | 1385 | 59.0 |
| WP_068370136.1 | 1386 | 59.0 |
| WP_070699874.1 | 1387 | 59.0 |
| WP_072469687.1 | 1388 | 59.0 |
| WP_085875992.1 | 1389 | 59.0 |
| WP_176269698.1 | 1390 | 59.0 |
| WP_176270218.1 | 1391 | 59.0 |
| WP_195445719.1 | 1392 | 59.0 |
| WP_242846544.1 | 1393 | 59.0 |
| WP_265214713.1 | 1394 | 59.0 |
| WP_273497992.1 | 1395 | 59.0 |
| WP_278726342.1 | 1396 | 59.0 |
| WP_285072970.1 | 1397 | 59.0 |
| WP_285091446.1 | 1398 | 59.0 |
| WP_297789646.1 | 1399 | 59.0 |
| WP_304065734.1 | 1400 | 59.0 |
| WP_316082558.1 | 1401 | 59.0 |
| WP_316263983.1 | 1402 | 59.0 |
| WP_316271836.1 | 1403 | 59.0 |
| WP_316531565.1 | 1404 | 59.0 |
| WP_316713042.1 | 1405 | 59.0 |
| WP_320595860.1 | 1406 | 59.0 |
| WP_339351660.1 | 1407 | 59.0 |
| MBM3454677.1 | 1408 | 58.8 |
| WP_137658154.1 | 1409 | 58.8 |
| MBP3823215.1 | 1410 | 58.6 |
| DAD72903.1 | 1411 | 58.5 |
| DAE36560.1 | 1412 | 58.5 |
| DAE79616.1 | 1413 | 58.5 |
| DAG71853.1 | 1414 | 58.5 |
| DAH37335.1 | 1415 | 58.5 |
| DAH73610.1 | 1416 | 58.5 |
| DAJ49710.1 | 1417 | 58.5 |
| DAK79329.1 | 1418 | 58.5 |
| DAL72843.1 | 1419 | 58.5 |
| DAN00457.1 | 1420 | 58.5 |
| DAN97814.1 | 1421 | 58.5 |
| DAO78994.1 | 1422 | 58.5 |
| DAQ88132.1 | 1423 | 58.5 |
| DAR90074.1 | 1424 | 58.5 |
| DAT70674.1 | 1425 | 58.5 |
| DAU07598.1 | 1426 | 58.5 |
| DAX83517.1 | 1427 | 58.5 |
| DAY55160.1 | 1428 | 58.5 |
| DAY63153.1 | 1429 | 58.5 |
| DAY70274.1 | 1430 | 58.5 |
| DAZ06055.1 | 1431 | 58.5 |
| EDR98670.1 | 1432 | 58.5 |
| HCB90396.1 | 1433 | 58.5 |
| HEN3196485.1 | 1434 | 58.5 |
| HEO2154627.1 | 1435 | 58.5 |
| HEP7759283.1 | 1436 | 58.5 |
| HES5012758.1 | 1437 | 58.5 |
| MBE5719514.1 | 1438 | 58.5 |
| MBF0935596.1 | 1439 | 58.5 |
| MBF0942281.1 | 1440 | 58.5 |
| MBF0942750.1 | 1441 | 58.5 |
| MBO5554600.1 | 1442 | 58.5 |
| MBP3868423.1 | 1443 | 58.5 |
| MBQ1535426.1 | 1444 | 58.5 |
| MBQ7536269.1 | 1445 | 58.5 |
| MBQ8069001.1 | 1446 | 58.5 |
| MBR2990305.1 | 1447 | 58.5 |
| MBR4455732.1 | 1448 | 58.5 |
| MBS4899850.1 | 1449 | 58.5 |
| MBS5114513.1 | 1450 | 58.5 |
| MCH5195954.1 | 1451 | 58.5 |
| MCH5207535.1 | 1452 | 58.5 |
| MCI8753175.1 | 1453 | 58.5 |
| MCM1497131.1 | 1454 | 58.5 |
| MCR0265655.1 | 1455 | 58.5 |
| MDB7998989.1 | 1456 | 58.5 |
| MDO4872672.1 | 1457 | 58.5 |
| MDO5018820.1 | 1458 | 58.5 |
| MDR0880914.1 | 1459 | 58.5 |
| MDR3136782.1 | 1460 | 58.5 |
| MDU2292470.1 | 1461 | 58.5 |
| MDU3325762.1 | 1462 | 58.5 |
| MDU3532159.1 | 1463 | 58.5 |
| MDU5246805.1 | 1464 | 58.5 |
| MDY2940917.1 | 1465 | 58.5 |
| MED5846031.1 | 1466 | 58.5 |
| QAT50916.1 | 1467 | 58.5 |
| QBZ72893.1 | 1468 | 58.5 |
| QBZ73215.1 | 1469 | 58.5 |
| QDH92752.1 | 1470 | 58.5 |
| QKH47416.1 | 1471 | 58.5 |
| RFT36047.1 | 1472 | 58.5 |
| RIY29961.1 | 1473 | 58.5 |
| RKW14997.1 | 1474 | 58.5 |
| SFE01904.1 | 1475 | 58.5 |
| UVM99539.1 | 1476 | 58.5 |
| WNM67997.1 | 1477 | 58.5 |
| WP_009269295.1 | 1478 | 58.5 |
| WP_019133547.1 | 1479 | 58.5 |
| WP_019190634.1 | 1480 | 58.5 |
| WP_020757759.1 | 1481 | 58.5 |
| WP_022866279.1 | 1482 | 58.5 |
| WP_023391808.1 | 1483 | 58.5 |
| WP_065189629.1 | 1484 | 58.5 |
| WP_070641721.1 | 1485 | 58.5 |
| WP_071132528.1 | 1486 | 58.5 |
| WP_071705048.1 | 1487 | 58.5 |
| WP_073382452.1 | 1488 | 58.5 |
| WP_074667897.1 | 1489 | 58.5 |
| WP_074667968.1 | 1490 | 58.5 |
| WP_075523958.1 | 1491 | 58.5 |
| WP_075712035.1 | 1492 | 58.5 |
| WP_101887622.1 | 1493 | 58.5 |
| WP_103013458.1 | 1494 | 58.5 |
| WP_103014085.1 | 1495 | 58.5 |
| WP_103043209.1 | 1496 | 58.5 |
| WP_116440732.1 | 1497 | 58.5 |
| WP_116712567.1 | 1498 | 58.5 |
| WP_132226174.1 | 1499 | 58.5 |
| WP_172355546.1 | 1500 | 58.5 |
| WP_208075871.1 | 1501 | 58.5 |
| WP_222199098.1 | 1502 | 58.5 |
| WP_230454752.1 | 1503 | 58.5 |
| WP_268445599.1 | 1504 | 58.5 |
| WP_269310727.1 | 1505 | 58.5 |
| WP_284761781.1 | 1506 | 58.5 |
| WP_285068298.1 | 1507 | 58.5 |
| WP_285072900.1 | 1508 | 58.5 |
| WP_285085367.1 | 1509 | 58.5 |
| WP_288686255.1 | 1510 | 58.5 |
| WP_291431937.1 | 1511 | 58.5 |

TABLE 7-continued

CW_7 repeat-containing protein sequences and sequence identity to CLB2 CW_7.

| GenBank | SEQ | ID % |
|---|---|---|
| WP_291432595.1 | 1512 | 58.5 |
| WP_291454566.1 | 1513 | 58.5 |
| WP_294143885.1 | 1514 | 58.5 |
| WP_303766305.1 | 1515 | 58.5 |
| WP_311466807.1 | 1516 | 58.5 |
| WP_311468163.1 | 1517 | 58.5 |
| WP_311537681.1 | 1518 | 58.5 |
| WP_314050720.1 | 1519 | 58.5 |
| WP_314064708.1 | 1520 | 58.5 |
| WP_314181765.1 | 1521 | 58.5 |
| WP_314198117.1 | 1522 | 58.5 |
| WP_314211913.1 | 1523 | 58.5 |
| WP_314250476.1 | 1524 | 58.5 |
| WP_314330401.1 | 1525 | 58.5 |
| WP_314693334.1 | 1526 | 58.5 |
| WP_314943685.1 | 1527 | 58.5 |
| WP_315025765.1 | 1528 | 58.5 |
| WP_315272755.1 | 1529 | 58.5 |
| WP_315600779.1 | 1530 | 58.5 |
| WP_316054981.1 | 1531 | 58.5 |
| WP_316276503.1 | 1532 | 58.5 |
| WP_316278639.1 | 1533 | 58.5 |
| WP_316709084.1 | 1534 | 58.5 |
| WP_320756368.1 | 1535 | 58.5 |
| WP_338153073.1 | 1536 | 58.5 |
| WP_338543391.1 | 1537 | 58.5 |
| YP_009624165.1 | 1538 | 58.5 |
| YP_009624223.1 | 1539 | 58.5 |
| AIA84369.1 | 1540 | 58.5 |
| MCL2545587.1 | 1541 | 58.5 |
| MCR5486349.1 | 1542 | 58.5 |
| WP_308609988.1 | 1543 | 58.5 |
| WP_314181128.1 | 1544 | 58.5 |
| MDE5642763.1 | 1545 | 58.3 |
| WP_153122072.1 | 1546 | 58.3 |
| AUI56361.1 | 1547 | 58.3 |
| DAF70151.1 | 1548 | 58.3 |
| DAG86485.1 | 1549 | 58.3 |
| DAJ59400.1 | 1550 | 58.3 |
| DAR23206.1 | 1551 | 58.3 |
| HIU04681.1 | 1552 | 58.3 |
| MBR3977748.1 | 1553 | 58.3 |
| MCI5543680.1 | 1554 | 58.3 |
| MCI7050931.1 | 1555 | 58.3 |
| MDE5791455.1 | 1556 | 58.3 |
| MDE6409347.1 | 1557 | 58.3 |
| MDY4557163.1 | 1558 | 58.3 |
| MEE0092799.1 | 1559 | 58.3 |
| WP_007365856.1 | 1560 | 58.3 |
| WP_009010225.1 | 1561 | 58.3 |
| WP_024628003.1 | 1562 | 58.3 |
| WP_077140485.1 | 1563 | 58.3 |
| WP_102048277.1 | 1564 | 58.3 |
| WP_131285126.1 | 1565 | 58.3 |
| WP_198208408.1 | 1566 | 58.3 |
| WP_277153947.1 | 1567 | 58.3 |
| WP_293965845.1 | 1568 | 58.3 |
| WP_296929086.1 | 1569 | 58.3 |
| WP_299282351.1 | 1570 | 58.3 |
| WP_305278004.1 | 1571 | 58.3 |
| WP_320643000.1 | 1572 | 58.3 |
| WP_320800265.1 | 1573 | 58.3 |
| WP_346748512.1 | 1574 | 58.3 |
| HER5200536.1 | 1575 | 57.9 |
| HES3276599.1 | 1576 | 57.9 |
| HRJ06874.1 | 1577 | 57.9 |
| MBO5028976.1 | 1578 | 57.9 |
| MCM1399858.1 | 1579 | 57.9 |
| VTZ99185.1 | 1580 | 57.9 |
| WP_012767360.1 | 1581 | 57.9 |
| WP_115253245.1 | 1582 | 57.9 |
| WP_158457394.1 | 1583 | 57.9 |
| WP_242668385.1 | 1584 | 57.9 |
| ACD98581.1 | 1585 | 57.9 |
| AUD83070.1 | 1586 | 57.9 |
| AZR97677.1 | 1587 | 57.9 |
| DAD57082.1 | 1588 | 57.9 |
| DAE09850.1 | 1589 | 57.9 |
| DAF51537.1 | 1590 | 57.9 |
| DAG04105.1 | 1591 | 57.9 |
| DAM40397.1 | 1592 | 57.9 |
| DAM70826.1 | 1593 | 57.9 |
| DAO55094.1 | 1594 | 57.9 |
| DAO79557.1 | 1595 | 57.9 |
| DAO88179.1 | 1596 | 57.9 |
| DAQ54961.1 | 1597 | 57.9 |
| DAT51229.1 | 1598 | 57.9 |
| DAT69343.1 | 1599 | 57.9 |
| DAT78118.1 | 1600 | 57.9 |
| DAT86970.1 | 1601 | 57.9 |
| DAV58332.1 | 1602 | 57.9 |
| DAW17549.1 | 1603 | 57.9 |
| DAW28399.1 | 1604 | 57.9 |
| DAW97714.1 | 1605 | 57.9 |
| DAY73495.1 | 1606 | 57.9 |
| DAZ29637.1 | 1607 | 57.9 |
| GDZ20669.1 | 1608 | 57.9 |
| GDZ39116.1 | 1609 | 57.9 |
| GDZ42888.1 | 1610 | 57.9 |
| HEL1579987.1 | 1611 | 57.9 |
| HEL1588853.1 | 1612 | 57.9 |
| HEL1656628.1 | 1613 | 57.9 |
| HEL1701650.1 | 1614 | 57.9 |
| HEL1771769.1 | 1615 | 57.9 |
| HEL1826226.1 | 1616 | 57.9 |
| HEL2068769.1 | 1617 | 57.9 |
| HEL2246364.1 | 1618 | 57.9 |
| HEL2620179.1 | 1619 | 57.9 |
| HEL2723699.1 | 1620 | 57.9 |
| HEL9635983.1 | 1621 | 57.9 |
| HEM2738596.1 | 1622 | 57.9 |
| HEM3451942.1 | 1623 | 57.9 |
| HEM3544385.1 | 1624 | 57.9 |
| HEM3602480.1 | 1625 | 57.9 |
| HEM3616496.1 | 1626 | 57.9 |
| HEM4003223.1 | 1627 | 57.9 |
| HEM4275232.1 | 1628 | 57.9 |
| HEM5103866.1 | 1629 | 57.9 |
| HEM5107069.1 | 1630 | 57.9 |
| HEM5175194.1 | 1631 | 57.9 |
| HEM6233304.1 | 1632 | 57.9 |
| HEM6253175.1 | 1633 | 57.9 |
| HEN2239575.1 | 1634 | 57.9 |
| HEN2249115.1 | 1635 | 57.9 |
| HEN7671129.1 | 1636 | 57.9 |
| HEO0332119.1 | 1637 | 57.9 |
| HEO5518101.1 | 1638 | 57.9 |
| HEO6871682.1 | 1639 | 57.9 |
| HEO7195634.1 | 1640 | 57.9 |
| HEP2841441.1 | 1641 | 57.9 |
| HEQ2314291.1 | 1642 | 57.9 |
| HES3505100.1 | 1643 | 57.9 |
| KAB5830440.1 | 1644 | 57.9 |
| KAB6879382.1 | 1645 | 57.9 |
| KAB6912924.1 | 1646 | 57.9 |
| KAB7203424.1 | 1647 | 57.9 |
| KAB7247809.1 | 1648 | 57.9 |
| MBD9019592.1 | 1649 | 57.9 |
| MBL6538710.1 | 1650 | 57.9 |
| MBP3705894.1 | 1651 | 57.9 |
| MBP3773205.1 | 1652 | 57.9 |
| MBQ0154945.1 | 1653 | 57.9 |
| MBQ2174130.1 | 1654 | 57.9 |
| MBR0451785.1 | 1655 | 57.9 |
| MBR3244943.1 | 1656 | 57.9 |
| MBR3355398.1 | 1657 | 57.9 |
| MBS4750310.1 | 1658 | 57.9 |
| MBS4751124.1 | 1659 | 57.9 |
| MBS5806401.1 | 1660 | 57.9 |
| MCC9684189.1 | 1661 | 57.9 |

TABLE 7-continued

CW_7 repeat-containing protein sequences and sequence identity to CLB2 CW_7.

| GenBank | SEQ | ID % |
|---|---|---|
| MCT6836136.1 | 1662 | 57.9 |
| MDB6802159.1 | 1663 | 57.9 |
| MDD6314572.1 | 1664 | 57.9 |
| MDE7031932.1 | 1665 | 57.9 |
| MDO5137252.1 | 1666 | 57.9 |
| MDO5763724.1 | 1667 | 57.9 |
| MDR3975362.1 | 1668 | 57.9 |
| MDR4068528.1 | 1669 | 57.9 |
| MDU1103542.1 | 1670 | 57.9 |
| MDU2273731.1 | 1671 | 57.9 |
| MDU2645528.1 | 1672 | 57.9 |
| MDU3739750.1 | 1673 | 57.9 |
| MDU6842693.1 | 1674 | 57.9 |
| MDU7112524.1 | 1675 | 57.9 |
| MZN84138.1 | 1676 | 57.9 |
| NEW62762.1 | 1677 | 57.9 |
| NQI37392.1 | 1678 | 57.9 |
| NQI43944.1 | 1679 | 57.9 |
| NQK17566.1 | 1680 | 57.9 |
| NQL70505.1 | 1681 | 57.9 |
| NQM29350.1 | 1682 | 57.9 |
| NQO28153.1 | 1683 | 57.9 |
| NRG75228.1 | 1684 | 57.9 |
| QBX31095.1 | 1685 | 57.9 |
| QCH29864.1 | 1686 | 57.9 |
| QSJ04948.1 | 1687 | 57.9 |
| RHK25409.1 | 1688 | 57.9 |
| TCE30094.1 | 1689 | 57.9 |
| UVY50696.1 | 1690 | 57.9 |
| VTT22659.1 | 1691 | 57.9 |
| VUX27149.1 | 1692 | 57.9 |
| WP_000405192.1 | 1693 | 57.9 |
| WP_003058531.1 | 1694 | 57.9 |
| WP_003809895.1 | 1695 | 57.9 |
| WP_012577888.1 | 1696 | 57.9 |
| WP_012578122.1 | 1697 | 57.9 |
| WP_015512446.1 | 1698 | 57.9 |
| WP_016456264.1 | 1699 | 57.9 |
| WP_016462192.1 | 1700 | 57.9 |
| WP_017646318.1 | 1701 | 57.9 |
| WP_021975127.1 | 1702 | 57.9 |
| WP_024381117.1 | 1703 | 57.9 |
| WP_024402343.1 | 1704 | 57.9 |
| WP_025221567.1 | 1705 | 57.9 |
| WP_028124894.1 | 1706 | 57.9 |
| WP_029172513.1 | 1707 | 57.9 |
| WP_029174192.1 | 1708 | 57.9 |
| WP_029177039.1 | 1709 | 57.9 |
| WP_029188011.1 | 1710 | 57.9 |
| WP_029944245.1 | 1711 | 57.9 |
| WP_032511597.1 | 1712 | 57.9 |
| WP_033499772.1 | 1713 | 57.9 |
| WP_042989283.1 | 1714 | 57.9 |
| WP_043035813.1 | 1715 | 57.9 |
| WP_043035881.1 | 1716 | 57.9 |
| WP_044475375.1 | 1717 | 57.9 |
| WP_044685867.1 | 1718 | 57.9 |
| WP_044762272.1 | 1719 | 57.9 |
| WP_044768355.1 | 1720 | 57.9 |
| WP_044981197.1 | 1721 | 57.9 |
| WP_044981552.1 | 1722 | 57.9 |
| WP_044981988.1 | 1723 | 57.9 |
| WP_044983651.1 | 1724 | 57.9 |
| WP_046999710.1 | 1725 | 57.9 |
| WP_052789094.1 | 1726 | 57.9 |
| WP_052789180.1 | 1727 | 57.9 |
| WP_052828307.1 | 1728 | 57.9 |
| WP_052828864.1 | 1729 | 57.9 |
| WP_053793983.1 | 1730 | 57.9 |
| WP_060618769.1 | 1731 | 57.9 |
| WP_065359301.1 | 1732 | 57.9 |
| WP_065435955.1 | 1733 | 57.9 |
| WP_065463870.1 | 1734 | 57.9 |
| WP_069483631.1 | 1735 | 57.9 |
| WP_071478650.1 | 1736 | 57.9 |
| WP_074390740.1 | 1737 | 57.9 |
| WP_074410879.1 | 1738 | 57.9 |
| WP_074412339.1 | 1739 | 57.9 |
| WP_077387445.1 | 1740 | 57.9 |
| WP_080788981.1 | 1741 | 57.9 |
| WP_080825764.1 | 1742 | 57.9 |
| WP_085061783.1 | 1743 | 57.9 |
| WP_085462022.1 | 1744 | 57.9 |
| WP_094750245.1 | 1745 | 57.9 |
| WP_094754216.1 | 1746 | 57.9 |
| WP_095346227.1 | 1747 | 57.9 |
| WP_099806553.1 | 1748 | 57.9 |
| WP_099831302.1 | 1749 | 57.9 |
| WP_099872288.1 | 1750 | 57.9 |
| WP_101625614.1 | 1751 | 57.9 |
| WP_103619853.1 | 1752 | 57.9 |
| WP_105105021.1 | 1753 | 57.9 |
| WP_105121160.1 | 1754 | 57.9 |
| WP_105141124.1 | 1755 | 57.9 |
| WP_105146533.1 | 1756 | 57.9 |
| WP_105148944.1 | 1757 | 57.9 |
| WP_105243469.1 | 1758 | 57.9 |
| WP_106621362.1 | 1759 | 57.9 |
| WP_106641205.1 | 1760 | 57.9 |
| WP_106641922.1 | 1761 | 57.9 |
| WP_106642225.1 | 1762 | 57.9 |
| WP_106647769.1 | 1763 | 57.9 |
| WP_117675095.1 | 1764 | 57.9 |
| WP_117760746.1 | 1765 | 57.9 |
| WP_118233682.1 | 1766 | 57.9 |
| WP_118240201.1 | 1767 | 57.9 |
| WP_124879890.1 | 1768 | 57.9 |
| WP_125968961.1 | 1769 | 57.9 |
| WP_130082218.1 | 1770 | 57.9 |
| WP_131202632.1 | 1771 | 57.9 |
| WP_131204644.1 | 1772 | 57.9 |
| WP_131211467.1 | 1773 | 57.9 |
| WP_131213011.1 | 1774 | 57.9 |
| WP_131215343.1 | 1775 | 57.9 |
| WP_131219195.1 | 1776 | 57.9 |
| WP_131222987.1 | 1777 | 57.9 |
| WP_131223344.1 | 1778 | 57.9 |
| WP_131226490.1 | 1779 | 57.9 |
| WP_131227588.1 | 1780 | 57.9 |
| WP_131232821.1 | 1781 | 57.9 |
| WP_131269643.1 | 1782 | 57.9 |
| WP_131272326.1 | 1783 | 57.9 |
| WP_131274815.1 | 1784 | 57.9 |
| WP_131276520.1 | 1785 | 57.9 |
| WP_131308332.1 | 1786 | 57.9 |
| WP_131311849.1 | 1787 | 57.9 |
| WP_131312620.1 | 1788 | 57.9 |
| WP_140489375.1 | 1789 | 57.9 |
| WP_141430348.1 | 1790 | 57.9 |
| WP_141671924.1 | 1791 | 57.9 |
| WP_141674572.1 | 1792 | 57.9 |
| WP_143882195.1 | 1793 | 57.9 |
| WP_143935305.1 | 1794 | 57.9 |
| WP_143935360.1 | 1795 | 57.9 |
| WP_150335069.1 | 1796 | 57.9 |
| WP_154536374.1 | 1797 | 57.9 |
| WP_155778325.1 | 1798 | 57.9 |
| WP_156624917.1 | 1799 | 57.9 |
| WP_166985220.1 | 1800 | 57.9 |
| WP_170078900.1 | 1801 | 57.9 |
| WP_172636267.1 | 1802 | 57.9 |
| WP_174773048.1 | 1803 | 57.9 |
| WP_193641916.1 | 1804 | 57.9 |
| WP_193642109.1 | 1805 | 57.9 |
| WP_195215338.1 | 1806 | 57.9 |
| WP_195242395.1 | 1807 | 57.9 |
| WP_195327706.1 | 1808 | 57.9 |
| WP_195403507.1 | 1809 | 57.9 |
| WP_195546269.1 | 1810 | 57.9 |
| WP_195554420.1 | 1811 | 57.9 |

TABLE 7-continued

CW_7 repeat-containing protein sequences and sequence identity to CLB2 CW_7.

| GenBank | SEQ | ID % |
|---|---|---|
| WP_195950182.1 | 1812 | 57.9 |
| WP_207121999.1 | 1813 | 57.9 |
| WP_212104396.1 | 1814 | 57.9 |
| WP_213291891.1 | 1815 | 57.9 |
| WP_221864722.1 | 1816 | 57.9 |
| WP_222366459.1 | 1817 | 57.9 |
| WP_225030917.1 | 1818 | 57.9 |
| WP_225724420.1 | 1819 | 57.9 |
| WP_226590796.1 | 1820 | 57.9 |
| WP_227112735.1 | 1821 | 57.9 |
| WP_227248064.1 | 1822 | 57.9 |
| WP_227976749.1 | 1823 | 57.9 |
| WP_230334819.1 | 1824 | 57.9 |
| WP_230335156.1 | 1825 | 57.9 |
| WP_232782508.1 | 1826 | 57.9 |
| WP_233889466.1 | 1827 | 57.9 |
| WP_237936378.1 | 1828 | 57.9 |
| WP_238374775.1 | 1829 | 57.9 |
| WP_238708320.1 | 1830 | 57.9 |
| WP_238715806.1 | 1831 | 57.9 |
| WP_238716089.1 | 1832 | 57.9 |
| WP_238718653.1 | 1833 | 57.9 |
| WP_240332476.1 | 1834 | 57.9 |
| WP_243093111.1 | 1835 | 57.9 |
| WP_247214245.1 | 1836 | 57.9 |
| WP_251178057.1 | 1837 | 57.9 |
| WP_254426360.1 | 1838 | 57.9 |
| WP_270266914.1 | 1839 | 57.9 |
| WP_270552974.1 | 1840 | 57.9 |
| WP_270557501.1 | 1841 | 57.9 |
| WP_274982750.1 | 1842 | 57.9 |
| WP_276340766.1 | 1843 | 57.9 |
| WP_277837921.1 | 1844 | 57.9 |
| WP_277846827.1 | 1845 | 57.9 |
| WP_279276159.1 | 1846 | 57.9 |
| WP_281108839.1 | 1847 | 57.9 |
| WP_281109158.1 | 1848 | 57.9 |
| WP_282917198.1 | 1849 | 57.9 |
| WP_283840623.1 | 1850 | 57.9 |
| WP_286112456.1 | 1851 | 57.9 |
| WP_286275937.1 | 1852 | 57.9 |
| WP_302395969.1 | 1853 | 57.9 |
| WP_308748144.1 | 1854 | 57.9 |
| WP_311896896.1 | 1855 | 57.9 |
| WP_313175263.1 | 1856 | 57.9 |
| WP_316113874.1 | 1857 | 57.9 |
| WP_316719505.1 | 1858 | 57.9 |
| WP_319640467.1 | 1859 | 57.9 |
| WP_322116319.1 | 1860 | 57.9 |
| WP_332404635.1 | 1861 | 57.9 |
| WP_332419454.1 | 1862 | 57.9 |
| WP_336375084.1 | 1863 | 57.9 |
| WP_336382926.1 | 1864 | 57.9 |
| WP_336622045.1 | 1865 | 57.9 |
| WP_340506320.1 | 1866 | 57.9 |
| WP_340508667.1 | 1867 | 57.9 |
| WP_346980136.1 | 1868 | 57.9 |
| WP_353061843.1 | 1869 | 57.9 |
| WP_353341891.1 | 1870 | 57.9 |
| WP_367007134.1 | 1871 | 57.9 |
| HCC03445.1 | 1872 | 57.6 |
| DAF78738.1 | 1873 | 57.5 |
| DAG19841.1 | 1874 | 57.5 |
| DAH71804.1 | 1875 | 57.5 |
| MDO4558618.1 | 1876 | 57.5 |
| MEE0108856.1 | 1877 | 57.5 |
| MBR4693974.1 | 1878 | 57.1 |
| QHJ77966.1 | 1879 | 57.1 |
| WP_052046911.1 | 1880 | 57.1 |
| WP_171002150.1 | 1881 | 57.1 |
| WP_275950418.1 | 1882 | 57.1 |
| WP_278755745.1 | 1883 | 57.1 |
| CDC16819.1 | 1884 | 57.1 |
| DAH53788.1 | 1885 | 57.1 |
| DAZ67110.1 | 1886 | 57.1 |
| MBR2553442.1 | 1887 | 57.1 |
| MCI1791735.1 | 1888 | 57.1 |
| MDB1433275.1 | 1889 | 57.1 |
| MDB1522669.1 | 1890 | 57.1 |
| NQP40272.1 | 1891 | 57.1 |
| QGZ17207.1 | 1892 | 57.1 |
| UVX44797.1 | 1893 | 57.1 |
| UWH96150.1 | 1894 | 57.1 |
| WP_078392067.1 | 1895 | 57.1 |
| WP_179395066.1 | 1896 | 57.1 |
| WP_179395723.1 | 1897 | 57.1 |
| WP_270199170.1 | 1898 | 57.1 |
| WP_270435525.1 | 1899 | 57.1 |
| WP_291290432.1 | 1900 | 57.1 |
| WP_304312188.1 | 1901 | 57.1 |
| WP_304313039.1 | 1902 | 57.1 |
| WP_331341121.1 | 1903 | 57.1 |
| DAL77996.1 | 1904 | 56.8 |
| DAO11437.1 | 1905 | 56.8 |
| DAP14690.1 | 1906 | 56.8 |
| DAP15758.1 | 1907 | 56.8 |
| DAQ77759.1 | 1908 | 56.8 |
| DAS01115.1 | 1909 | 56.8 |
| GDZ75061.1 | 1910 | 56.8 |
| KAB5744127.1 | 1911 | 56.8 |
| MBS5345044.1 | 1912 | 56.8 |
| MBV3434105.1 | 1913 | 56.8 |
| MDU6622586.1 | 1914 | 56.8 |
| NEG90614.1 | 1915 | 56.8 |
| PIB81455.1 | 1916 | 56.8 |
| QHJ77918.1 | 1917 | 56.8 |
| RHI43312.1 | 1918 | 56.8 |
| WP_051872044.1 | 1919 | 56.8 |
| WP_055308661.1 | 1920 | 56.8 |
| WP_117632188.1 | 1921 | 56.8 |
| WP_163191062.1 | 1922 | 56.8 |
| WP_180753752.1 | 1923 | 56.8 |
| WP_182300940.1 | 1924 | 56.8 |
| WP_195537610.1 | 1925 | 56.8 |
| WP_215641116.1 | 1926 | 56.8 |
| WP_217374874.1 | 1927 | 56.8 |
| WP_217752127.1 | 1928 | 56.8 |
| WP_236716572.1 | 1929 | 56.8 |
| WP_239512566.1 | 1930 | 56.8 |
| WP_248004584.1 | 1931 | 56.8 |
| WP_254879273.1 | 1932 | 56.8 |
| WP_281097719.1 | 1933 | 56.8 |
| WP_291789214.1 | 1934 | 56.8 |
| WP_333721000.1 | 1935 | 56.8 |
| WP_340504884.1 | 1936 | 56.8 |
| WP_347009974.1 | 1937 | 56.8 |
| WP_347010046.1 | 1938 | 56.8 |
| WP_347012031.1 | 1939 | 56.8 |
| WP_349615380.1 | 1940 | 56.8 |
| MCI1220142.1 | 1941 | 56.8 |
| MCI1831558.1 | 1942 | 56.8 |
| MDB1467710.1 | 1943 | 56.8 |
| MDQ8821206.1 | 1944 | 56.8 |
| WP_155971571.1 | 1945 | 56.8 |
| WP_237373375.1 | 1946 | 56.8 |
| WP_270435228.1 | 1947 | 56.8 |
| WP_278759887.1 | 1948 | 56.8 |
| WP_297571616.1 | 1949 | 56.8 |
| DAZ11612.1 | 1950 | 56.4 |
| KGF10429.1 | 1951 | 56.4 |
| MBG9985043.1 | 1952 | 56.4 |
| MBQ9141165.1 | 1953 | 56.4 |
| MBQ9702954.1 | 1954 | 56.4 |
| MCI7239241.1 | 1955 | 56.4 |
| MCM1164526.1 | 1956 | 56.4 |
| MDD6060844.1 | 1957 | 56.4 |
| MDD7512789.1 | 1958 | 56.4 |
| MDE7229523.1 | 1959 | 56.4 |
| MEE0955794.1 | 1960 | 56.4 |
| MEE3495755.1 | 1961 | 56.4 |

TABLE 7-continued

CW_7 repeat-containing protein sequences and sequence identity to CLB2 CW_7.

| GenBank | SEQ | ID % |
|---|---|---|
| WP_008901321.1 | 1962 | 56.4 |
| WP_018659237.1 | 1963 | 56.4 |
| WP_144398628.1 | 1964 | 56.4 |
| WP_151410295.1 | 1965 | 56.4 |
| WP_151410757.1 | 1966 | 56.4 |
| WP_171332503.1 | 1967 | 56.4 |
| WP_242949812.1 | 1968 | 56.4 |
| WP_270289037.1 | 1969 | 56.4 |
| WP_277261500.1 | 1970 | 56.4 |
| WP_278662706.1 | 1971 | 56.4 |
| WP_278735896.1 | 1972 | 56.4 |
| WP_316085599.1 | 1973 | 56.4 |
| WP_316131176.1 | 1974 | 56.4 |
| WP_332087527.1 | 1975 | 56.4 |
| HJA82050.1 | 1976 | 56.3 |
| MBR3611803.1 | 1977 | 56.3 |
| MCF0103977.1 | 1978 | 56.3 |
| MDD6079003.1 | 1979 | 56.3 |
| MDE7414300.1 | 1980 | 56.3 |
| MDR1723185.1 | 1981 | 56.3 |
| OQC00166.1 | 1982 | 56.3 |
| WP_028906126.1 | 1983 | 56.3 |
| WP_100190139.1 | 1984 | 56.3 |
| WP_278901691.1 | 1985 | 56.3 |
| WP_297036228.1 | 1986 | 56.3 |
| WP_308274766.1 | 1987 | 56.3 |
| AMP42248.1 | 1988 | 56.1 |
| ARP51107.1 | 1989 | 56.1 |
| DAF09946.1 | 1990 | 56.1 |
| DAF26406.1 | 1991 | 56.1 |
| DAG63190.1 | 1992 | 56.1 |
| DAH75037.1 | 1993 | 56.1 |
| DAI26982.1 | 1994 | 56.1 |
| DAJ84232.1 | 1995 | 56.1 |
| DAK28228.1 | 1996 | 56.1 |
| DAL27502.1 | 1997 | 56.1 |
| DAM76220.1 | 1998 | 56.1 |
| DAN07658.1 | 1999 | 56.1 |
| DAO49025.1 | 2000 | 56.1 |
| DAP74572.1 | 2001 | 56.1 |
| DAT44560.1 | 2002 | 56.1 |
| DAT72634.1 | 2003 | 56.1 |
| DAT94336.1 | 2004 | 56.1 |
| DAU31694.1 | 2005 | 56.1 |
| DAU45238.1 | 2006 | 56.1 |
| DAU79771.1 | 2007 | 56.1 |
| DAV68083.1 | 2008 | 56.1 |
| DAW88059.1 | 2009 | 56.1 |
| DAX35828.1 | 2010 | 56.1 |
| DAX71914.1 | 2011 | 56.1 |
| DAX82425.1 | 2012 | 56.1 |
| DAY37231.1 | 2013 | 56.1 |
| DAY91644.1 | 2014 | 56.1 |
| DAZ08544.1 | 2015 | 56.1 |
| DAZ77564.1 | 2016 | 56.1 |
| EHI70229.1 | 2017 | 56.1 |
| EIK77200.1 | 2018 | 56.1 |
| EPI46407.1 | 2019 | 56.1 |
| HAK0935252.1 | 2020 | 56.1 |
| HDI3439610.1 | 2021 | 56.1 |
| HDM9179001.1 | 2022 | 56.1 |
| HEL8297230.1 | 2023 | 56.1 |
| HEL9517570.1 | 2024 | 56.1 |
| HIT89969.1 | 2025 | 56.1 |
| HJD00439.1 | 2026 | 56.1 |
| MBD5112395.1 | 2027 | 56.1 |
| MBE0296378.1 | 2028 | 56.1 |
| MBO5504405.1 | 2029 | 56.1 |
| MBP3793179.1 | 2030 | 56.1 |
| MBQ1368950.1 | 2031 | 56.1 |
| MBQ3052987.1 | 2032 | 56.1 |
| MBQ3195980.1 | 2033 | 56.1 |
| MBQ4247358.1 | 2034 | 56.1 |
| MBQ5522068.1 | 2035 | 56.1 |
| MBR1810973.1 | 2036 | 56.1 |
| MBR2552781.1 | 2037 | 56.1 |
| MBS6321888.1 | 2038 | 56.1 |
| MBY0585225.1 | 2039 | 56.1 |
| MCF1635260.1 | 2040 | 56.1 |
| MCR0459289.1 | 2041 | 56.1 |
| MDB7995994.1 | 2042 | 56.1 |
| MDH6602989.1 | 2043 | 56.1 |
| MDK0907098.1 | 2044 | 56.1 |
| MDU2829572.1 | 2045 | 56.1 |
| MEE3405559.1 | 2046 | 56.1 |
| MEO2812417.1 | 2047 | 56.1 |
| MEQ3114896.1 | 2048 | 56.1 |
| RFT26883.1 | 2049 | 56.1 |
| RGD77276.1 | 2050 | 56.1 |
| RHT19196.1 | 2051 | 56.1 |
| RIY26770.1 | 2052 | 56.1 |
| RYN08726.1 | 2053 | 56.1 |
| WP_002563674.1 | 2054 | 56.1 |
| WP_006268703.1 | 2055 | 56.1 |
| WP_014554482.1 | 2056 | 56.1 |
| WP_015527548.1 | 2057 | 56.1 |
| WP_019190763.1 | 2058 | 56.1 |
| WP_019260892.1 | 2059 | 56.1 |
| WP_022003216.1 | 2060 | 56.1 |
| WP_048730021.1 | 2061 | 56.1 |
| WP_057002046.1 | 2062 | 56.1 |
| WP_064340486.1 | 2063 | 56.1 |
| WP_070210517.1 | 2064 | 56.1 |
| WP_076002856.1 | 2065 | 56.1 |
| WP_084229876.1 | 2066 | 56.1 |
| WP_101890267.1 | 2067 | 56.1 |
| WP_102165511.1 | 2068 | 56.1 |
| WP_112928578.1 | 2069 | 56.1 |
| WP_115716436.1 | 2070 | 56.1 |
| WP_116691926.1 | 2071 | 56.1 |
| WP_150225723.1 | 2072 | 56.1 |
| WP_154574073.1 | 2073 | 56.1 |
| WP_156329537.1 | 2074 | 56.1 |
| WP_163051994.1 | 2075 | 56.1 |
| WP_169755928.1 | 2076 | 56.1 |
| WP_169759672.1 | 2077 | 56.1 |
| WP_174142812.1 | 2078 | 56.1 |
| WP_198609025.1 | 2079 | 56.1 |
| WP_203244668.1 | 2080 | 56.1 |
| WP_212821115.1 | 2081 | 56.1 |
| WP_227205741.1 | 2082 | 56.1 |
| WP_234944194.1 | 2083 | 56.1 |
| WP_235807546.1 | 2084 | 56.1 |
| WP_238609359.1 | 2085 | 56.1 |
| WP_248902513.1 | 2086 | 56.1 |
| WP_250310248.1 | 2087 | 56.1 |
| WP_257479905.1 | 2088 | 56.1 |
| WP_259295317.1 | 2089 | 56.1 |
| WP_262011342.1 | 2090 | 56.1 |
| WP_263477118.1 | 2091 | 56.1 |
| WP_270627091.1 | 2092 | 56.1 |
| WP_273497945.1 | 2093 | 56.1 |
| WP_278631542.1 | 2094 | 56.1 |
| WP_279361440.1 | 2095 | 56.1 |
| WP_284599057.1 | 2096 | 56.1 |
| WP_287714527.1 | 2097 | 56.1 |
| WP_287847047.1 | 2098 | 56.1 |
| WP_290944891.1 | 2099 | 56.1 |
| WP_301969808.1 | 2100 | 56.1 |
| WP_308460332.1 | 2101 | 56.1 |
| WP_314388786.1 | 2102 | 56.1 |
| WP_316263974.1 | 2103 | 56.1 |
| WP_316720043.1 | 2104 | 56.1 |
| WP_318779072.1 | 2105 | 56.1 |
| WP_320759079.1 | 2106 | 56.1 |
| WP_324250384.1 | 2107 | 56.1 |
| WP_346793692.1 | 2108 | 56.1 |
| WP_347561346.1 | 2109 | 56.1 |
| WP_349054446.1 | 2110 | 56.1 |
| WP_349198654.1 | 2111 | 56.1 |

TABLE 7-continued

CW_7 repeat-containing protein sequences and sequence identity to CLB2 CW_7.

| GenBank | SEQ | ID % |
|---|---|---|
| WP_353884781.1 | 2112 | 56.1 |
| WZL78343.1 | 2113 | 56.1 |
| DAJ95793.1 | 2114 | 56.1 |
| DAK 11742.1 | 2115 | 56.1 |
| DAY93561.1 | 2116 | 56.1 |
| EEG51680.1 | 2117 | 56.1 |
| MBF1710231.1 | 2118 | 56.1 |
| MBQ1482671.1 | 2119 | 56.1 |
| MBQ9354911.1 | 2120 | 56.1 |
| MCH4013796.1 | 2121 | 56.1 |
| MCQ2451066.1 | 2122 | 56.1 |
| MDE7398977.1 | 2123 | 56.1 |
| MDR2531453.1 | 2124 | 56.1 |
| WP_040413169.1 | 2125 | 56.1 |
| WP_101695398.1 | 2126 | 56.1 |
| WP_132226251.1 | 2127 | 56.1 |
| WP_166083092.1 | 2128 | 56.1 |
| WP_243036783.1 | 2129 | 56.1 |
| WP_266162965.1 | 2130 | 56.1 |
| WP_268445257.1 | 2131 | 56.1 |
| WP_303041128.1 | 2132 | 56.1 |
| DAF33623.1 | 2133 | 55.6 |
| DAF83562.1 | 2134 | 55.6 |
| DAI93989.1 | 2135 | 55.6 |
| DAN35609.1 | 2136 | 55.6 |
| DAP73465.1 | 2137 | 55.6 |
| DAQ10417.1 | 2138 | 55.6 |
| DAS90063.1 | 2139 | 55.6 |
| DAT59724.1 | 2140 | 55.6 |
| DAV85879.1 | 2141 | 55.6 |
| MBD5239140.1 | 2142 | 55.6 |
| MBD5307471.1 | 2143 | 55.6 |
| MBD5317425.1 | 2144 | 55.6 |
| MBD5329294.1 | 2145 | 55.6 |
| MBD5340291.1 | 2146 | 55.6 |
| MBF1066417.1 | 2147 | 55.6 |
| MBR6774619.1 | 2148 | 55.6 |
| MCI7597306.1 | 2149 | 55.6 |
| MCI7789137.1 | 2150 | 55.6 |
| MDE5949100.1 | 2151 | 55.6 |
| MDE7462233.1 | 2152 | 55.6 |
| MDR1847647.1 | 2153 | 55.6 |
| MEE1303351.1 | 2154 | 55.6 |
| WP_261254574.1 | 2155 | 55.6 |
| MCC8118958.1 | 2156 | 55.6 |
| MCM1139099.1 | 2157 | 55.6 |
| MDE6681836.1 | 2158 | 55.6 |
| MDY4174437.1 | 2159 | 55.6 |
| ROT06162.1 | 2160 | 55.6 |
| WP_298666286.1 | 2161 | 55.6 |
| WP_301425618.1 | 2162 | 55.6 |
| WP_317605757.1 | 2163 | 55.6 |
| DAD92565.1 | 2164 | 55.3 |
| DAP18054.1 | 2165 | 55.3 |
| DAV53526.1 | 2166 | 55.3 |
| ESA48234.1 | 2167 | 55.3 |
| HEL0213567.1 | 2168 | 55.3 |
| HEP1405784.1 | 2169 | 55.3 |
| HEP1471752.1 | 2170 | 55.3 |
| HER5200537.1 | 2171 | 55.3 |
| HES2369659.1 | 2172 | 55.3 |
| MBE6125010.1 | 2173 | 55.3 |
| MBS1338628.1 | 2174 | 55.3 |
| WP_003047591.1 | 2175 | 55.3 |
| WP_008788454.1 | 2176 | 55.3 |
| WP_027970273.1 | 2177 | 55.3 |
| WP_070021432.1 | 2178 | 55.3 |
| WP_072137518.1 | 2179 | 55.3 |
| WP_129735104.1 | 2180 | 55.3 |
| WP_143978738.1 | 2181 | 55.3 |
| WP_172636359.1 | 2182 | 55.3 |
| WP_278753828.1 | 2183 | 55.3 |
| WP_298625755.1 | 2184 | 55.3 |
| WP_332059051.1 | 2185 | 55.3 |
| CYW30588.1 | 2186 | 55.3 |
| DAE63310.1 | 2187 | 55.3 |
| DAE64095.1 | 2188 | 55.3 |
| DAH63468.1 | 2189 | 55.3 |
| DAI67139.1 | 2190 | 55.3 |
| DAL62505.1 | 2191 | 55.3 |
| DAN71249.1 | 2192 | 55.3 |
| DAO18124.1 | 2193 | 55.3 |
| DAO62516.1 | 2194 | 55.3 |
| DAY91163.1 | 2195 | 55.3 |
| HBA62284.1 | 2196 | 55.3 |
| HEL1607036.1 | 2197 | 55.3 |
| HEL1731552.1 | 2198 | 55.3 |
| HEL1827824.1 | 2199 | 55.3 |
| HEL1848996.1 | 2200 | 55.3 |
| HEL1906690.1 | 2201 | 55.3 |
| HEL1946020.1 | 2202 | 55.3 |
| HEL1990045.1 | 2203 | 55.3 |
| HEL2165130.1 | 2204 | 55.3 |
| HEL2204622.1 | 2205 | 55.3 |
| HEL2246585.1 | 2206 | 55.3 |
| HEL2274455.1 | 2207 | 55.3 |
| HEL2309173.1 | 2208 | 55.3 |
| HEL2361048.1 | 2209 | 55.3 |
| HEL2388842.1 | 2210 | 55.3 |
| HEL2532983.1 | 2211 | 55.3 |
| HEL2556427.1 | 2212 | 55.3 |
| HEL2623501.1 | 2213 | 55.3 |
| HEL2706394.1 | 2214 | 55.3 |
| HEL2737527.1 | 2215 | 55.3 |
| HEL9642804.1 | 2216 | 55.3 |
| HEM2578492.1 | 2217 | 55.3 |
| HEM2592442.1 | 2218 | 55.3 |
| HEM2716994.1 | 2219 | 55.3 |
| HEM2739629.1 | 2220 | 55.3 |
| HEM2744577.1 | 2221 | 55.3 |
| HEM2779440.1 | 2222 | 55.3 |
| HEM2965232.1 | 2223 | 55.3 |
| HEM3009479.1 | 2224 | 55.3 |
| HEM3188929.1 | 2225 | 55.3 |
| HEM3538283.1 | 2226 | 55.3 |
| HEM3568839.1 | 2227 | 55.3 |
| HEM3629242.1 | 2228 | 55.3 |
| HEM3634875.1 | 2229 | 55.3 |
| HEM3901436.1 | 2230 | 55.3 |
| HEM4159957.1 | 2231 | 55.3 |
| HEM4165687.1 | 2232 | 55.3 |
| HEM4211656.1 | 2233 | 55.3 |
| HEM4249624.1 | 2234 | 55.3 |
| HEM4275191.1 | 2235 | 55.3 |
| HEM4558431.1 | 2236 | 55.3 |
| HEM4669938.1 | 2237 | 55.3 |
| HEM4758691.1 | 2238 | 55.3 |
| HEM4809978.1 | 2239 | 55.3 |
| HEM5025496.1 | 2240 | 55.3 |
| HEM5155687.1 | 2241 | 55.3 |
| HEM5178871.1 | 2242 | 55.3 |
| HEM5208341.1 | 2243 | 55.3 |
| HEM5273925.1 | 2244 | 55.3 |
| HEM5414756.1 | 2245 | 55.3 |
| HEM5558310.1 | 2246 | 55.3 |
| HEM5914790.1 | 2247 | 55.3 |
| HEM6020058.1 | 2248 | 55.3 |
| HEM6060094.1 | 2249 | 55.3 |
| HEM6260877.1 | 2250 | 55.3 |
| HEM6539922.1 | 2251 | 55.3 |
| HEM6559758.1 | 2252 | 55.3 |
| HEN2620235.1 | 2253 | 55.3 |
| HEN6330911.1 | 2254 | 55.3 |
| HEN6765196.1 | 2255 | 55.3 |
| HEO4075700.1 | 2256 | 55.3 |
| HEP1824881.1 | 2257 | 55.3 |
| HEP1837845.1 | 2258 | 55.3 |
| HJI55575.1 | 2259 | 55.3 |
| KFI70369.1 | 2260 | 55.3 |
| MBD3948437.1 | 2261 | 55.3 |

TABLE 7-continued

CW_7 repeat-containing protein sequences and sequence identity to CLB2 CW_7.

| GenBank | SEQ | ID % |
|---|---|---|
| MBE6045466.1 | 2262 | 55.3 |
| MBM6800422.1 | 2263 | 55.3 |
| MBQ8300278.1 | 2264 | 55.3 |
| MBQ8829692.1 | 2265 | 55.3 |
| MBQ9314973.1 | 2266 | 55.3 |
| MCF0235551.1 | 2267 | 55.3 |
| MCK3958294.1 | 2268 | 55.3 |
| MCK4043381.1 | 2269 | 55.3 |
| MCK 4069752.1 | 2270 | 55.3 |
| MCK 4074199.1 | 2271 | 55.3 |
| MCT6837299.1 | 2272 | 55.3 |
| MCW6664506.1 | 2273 | 55.3 |
| MDB1414146.1 | 2274 | 55.3 |
| MDG3222526.1 | 2275 | 55.3 |
| MDG3327297.1 | 2276 | 55.3 |
| MDG4515229.1 | 2277 | 55.3 |
| MDO5044959.1 | 2278 | 55.3 |
| MDU2257702.1 | 2279 | 55.3 |
| MDU3152876.1 | 2280 | 55.3 |
| MDW8651054.1 | 2281 | 55.3 |
| MDW8691147.1 | 2282 | 55.3 |
| MEO2365327.1 | 2283 | 55.3 |
| MEO5477776.1 | 2284 | 55.3 |
| NCB79970.1 | 2285 | 55.3 |
| NQJ72043.1 | 2286 | 55.3 |
| NQN97692.1 | 2287 | 55.3 |
| NQP51549.1 | 2288 | 55.3 |
| QIG78226.1 | 2289 | 55.3 |
| RGJ86708.1 | 2290 | 55.3 |
| RGL08985.1 | 2291 | 55.3 |
| RGP03643.1 | 2292 | 55.3 |
| UNY50240.1 | 2293 | 55.3 |
| WP_000405191.1 | 2294 | 55.3 |
| WP_000405193.1 | 2295 | 55.3 |
| WP_000405194.1 | 2296 | 55.3 |
| WP_000512610.1 | 2297 | 55.3 |
| WP_000512611.1 | 2298 | 55.3 |
| WP_015984430.1 | 2299 | 55.3 |
| WP_024411103.1 | 2300 | 55.3 |
| WP_027972598.1 | 2301 | 55.3 |
| WP_031873482.1 | 2302 | 55.3 |
| WP_043033233.1 | 2303 | 55.3 |
| WP_044475330.1 | 2304 | 55.3 |
| WP_044673607.1 | 2305 | 55.3 |
| WP_044686576.1 | 2306 | 55.3 |
| WP_044765379.1 | 2307 | 55.3 |
| WP_044768204.1 | 2308 | 55.3 |
| WP_044769727.1 | 2309 | 55.3 |
| WP_044770619.1 | 2310 | 55.3 |
| WP_044777638.1 | 2311 | 55.3 |
| WP_044980624.1 | 2312 | 55.3 |
| WP_047199272.1 | 2313 | 55.3 |
| WP_050139094.1 | 2314 | 55.3 |
| WP_052109203.1 | 2315 | 55.3 |
| WP_053338578.1 | 2316 | 55.3 |
| WP_074390440.1 | 2317 | 55.3 |
| WP_074411214.1 | 2318 | 55.3 |
| WP_074412935.1 | 2319 | 55.3 |
| WP_075105671.1 | 2320 | 55.3 |
| WP_081888422.1 | 2321 | 55.3 |
| WP_086992449.1 | 2322 | 55.3 |
| WP_087013717.1 | 2323 | 55.3 |
| WP_093650205.1 | 2324 | 55.3 |
| WP_093651367.1 | 2325 | 55.3 |
| WP_105249449.1 | 2326 | 55.3 |
| WP_112477644.1 | 2327 | 55.3 |
| WP_115268807.1 | 2328 | 55.3 |
| WP_117649242.1 | 2329 | 55.3 |
| WP_121835595.1 | 2330 | 55.3 |
| WP_125064509.1 | 2331 | 55.3 |
| WP_141453391.1 | 2332 | 55.3 |
| WP_154312470.1 | 2333 | 55.3 |
| WP_170238636.1 | 2334 | 55.3 |
| WP_171842697.1 | 2335 | 55.3 |
| WP_172008793.1 | 2336 | 55.3 |
| WP_172049131.1 | 2337 | 55.3 |
| WP_172146131.1 | 2338 | 55.3 |
| WP_181974363.1 | 2339 | 55.3 |
| WP_181974846.1 | 2340 | 55.3 |
| WP_181978001.1 | 2341 | 55.3 |
| WP_184493500.1 | 2342 | 55.3 |
| WP_187324399.1 | 2343 | 55.3 |
| WP_187643793.1 | 2344 | 55.3 |
| WP_192584820.1 | 2345 | 55.3 |
| WP_201326711.1 | 2346 | 55.3 |
| WP_201344752.1 | 2347 | 55.3 |
| WP_208952971.1 | 2348 | 55.3 |
| WP_209107509.1 | 2349 | 55.3 |
| WP_226556948.1 | 2350 | 55.3 |
| WP_229026203.1 | 2351 | 55.3 |
| WP_229038133.1 | 2352 | 55.3 |
| WP_230233589.1 | 2353 | 55.3 |
| WP_238709205.1 | 2354 | 55.3 |
| WP_238712652.1 | 2355 | 55.3 |
| WP_240213898.1 | 2356 | 55.3 |
| WP_249547221.1 | 2357 | 55.3 |
| WP_250241380.1 | 2358 | 55.3 |
| WP_250243719.1 | 2359 | 55.3 |
| WP_253214900.1 | 2360 | 55.3 |
| WP_267399516.1 | 2361 | 55.3 |
| WP_270198124.1 | 2362 | 55.3 |
| WP_270545005.1 | 2363 | 55.3 |
| WP_271739249.1 | 2364 | 55.3 |
| WP_276861367.1 | 2365 | 55.3 |
| WP_277839434.1 | 2366 | 55.3 |
| WP_287847975.1 | 2367 | 55.3 |
| WP_288805159.1 | 2368 | 55.3 |
| WP_289875544.1 | 2369 | 55.3 |
| WP_307121200.1 | 2370 | 55.3 |
| WP_309465310.1 | 2371 | 55.3 |
| WP_312248546.1 | 2372 | 55.3 |
| WP_312249646.1 | 2373 | 55.3 |
| WP_313166747.1 | 2374 | 55.3 |
| WP_320891825.1 | 2375 | 55.3 |
| WP_322116448.1 | 2376 | 55.3 |
| WP_334116176.1 | 2377 | 55.3 |
| WP_336316985.1 | 2378 | 55.3 |
| WP_345754366.1 | 2379 | 55.3 |
| DAQ64515.1 | 2380 | 55.0 |
| MBR2793855.1 | 2381 | 55.0 |
| MCR4580955.1 | 2382 | 55.0 |
| WP_150888728.1 | 2383 | 55.0 |
| WP_236159998.1 | 2384 | 55.0 |
| WP_242225508.1 | 2385 | 55.0 |
| WP_314451601.1 | 2386 | 55.0 |
| DAH03703.1 | 2387 | 54.6 |
| BDR53684.1 | 2388 | 54.3 |
| DAK11539.1 | 2389 | 54.3 |
| DAV00982.1 | 2390 | 54.3 |
| HEM4972121.1 | 2391 | 54.3 |
| MCX4255226.1 | 2392 | 54.3 |
| MDR1544361.1 | 2393 | 54.3 |
| UYL88198.1 | 2394 | 54.3 |
| WP_231474071.1 | 2395 | 54.3 |
| WP_294158152.1 | 2396 | 54.3 |
| WP_337666808.1 | 2397 | 54.3 |
| WP_054278781.1 | 2398 | 54.3 |
| WP_179394738.1 | 2399 | 54.3 |
| DAQ00190.1 | 2400 | 54.1 |
| DAQ28118.1 | 2401 | 54.1 |
| WP_267444247.1 | 2402 | 54.1 |
| WP_277177605.1 | 2403 | 54.1 |
| DAJ50320.1 | 2404 | 54.1 |
| DAV30475.1 | 2405 | 54.1 |
| MBW3095564.1 | 2406 | 54.1 |
| WP_051616628.1 | 2407 | 54.1 |
| WP_236028236.1 | 2408 | 54.1 |
| DAQ21213.1 | 2409 | 53.9 |
| DAR46995.1 | 2410 | 53.9 |
| DAZ40338.1 | 2411 | 53.9 |

TABLE 7-continued

CW_7 repeat-containing protein sequences and sequence identity to CLB2 CW_7.

| GenBank | SEQ | ID % |
|---|---|---|
| HAF26374.1 | 2412 | 53.9 |
| MCI2061742.1 | 2413 | 53.9 |
| MDE5582231.1 | 2414 | 53.9 |
| MDE5763399.1 | 2415 | 53.9 |
| MDR0566243.1 | 2416 | 53.9 |
| WP_180501095.1 | 2417 | 53.9 |
| WP_294575553.1 | 2418 | 53.9 |
| WP_294575736.1 | 2419 | 53.9 |
| DAH16669.1 | 2420 | 53.8 |
| DAM77358.1 | 2421 | 53.8 |
| MBE6683485.1 | 2422 | 53.8 |
| MCR4996488.1 | 2423 | 53.8 |
| WP_242838930.1 | 2424 | 53.8 |
| WP_246441556.1 | 2425 | 53.8 |
| WP_282193015.1 | 2426 | 53.8 |
| WP_301425180.1 | 2427 | 53.8 |
| AMP54172.1 | 2428 | 53.7 |
| DAE09281.1 | 2429 | 53.7 |
| DAG15149.1 | 2430 | 53.7 |
| DAG39953.1 | 2431 | 53.7 |
| DAG53708.1 | 2432 | 53.7 |
| DAG63911.1 | 2433 | 53.7 |
| DAG74337.1 | 2434 | 53.7 |
| DAH39424.1 | 2435 | 53.7 |
| DAI53402.1 | 2436 | 53.7 |
| DAJ57149.1 | 2437 | 53.7 |
| DAO60284.1 | 2438 | 53.7 |
| DAQ84859.1 | 2439 | 53.7 |
| DAR42995.1 | 2440 | 53.7 |
| DAS34344.1 | 2441 | 53.7 |
| DAU05993.1 | 2442 | 53.7 |
| DAW50327.1 | 2443 | 53.7 |
| DAW54980.1 | 2444 | 53.7 |
| DAZ27623.1 | 2445 | 53.7 |
| EAC3599428.1 | 2446 | 53.7 |
| EAE8703439.1 | 2447 | 53.7 |
| EAF5068626.1 | 2448 | 53.7 |
| EEU7573063.1 | 2449 | 53.7 |
| EMG1576682.1 | 2450 | 53.7 |
| EOS70995.1 | 2451 | 53.7 |
| HBM3641119.1 | 2452 | 53.7 |
| HCJ4368719.1 | 2453 | 53.7 |
| MBQ8132902.1 | 2454 | 53.7 |
| MBQ9977163.1 | 2455 | 53.7 |
| MBR2677669.1 | 2456 | 53.7 |
| MBR2825753.1 | 2457 | 53.7 |
| MCD1906081.1 | 2458 | 53.7 |
| MCD3416480.1 | 2459 | 53.7 |
| MCI6652173.1 | 2460 | 53.7 |
| MCI6653629.1 | 2461 | 53.7 |
| MCM1333781.1 | 2462 | 53.7 |
| MCR0203747.1 | 2463 | 53.7 |
| MCR0248983.1 | 2464 | 53.7 |
| MDB6823545.1 | 2465 | 53.7 |
| MDD2490300.1 | 2466 | 53.7 |
| MDD6645959.1 | 2467 | 53.7 |
| MDD6708531.1 | 2468 | 53.7 |
| MDE8061506.1 | 2469 | 53.7 |
| MDK6295905.1 | 2470 | 53.7 |
| MEE0173444.1 | 2471 | 53.7 |
| MEQ2775527.1 | 2472 | 53.7 |
| RGS41704.1 | 2473 | 53.7 |
| UVN03315.1 | 2474 | 53.7 |
| UVY23390.1 | 2475 | 53.7 |
| WP_003762664.1 | 2476 | 53.7 |
| WP_004853830.1 | 2477 | 53.7 |
| WP_018659529.1 | 2478 | 53.7 |
| WP_065189413.1 | 2479 | 53.7 |
| WP_067632669.1 | 2480 | 53.7 |
| WP_127722940.1 | 2481 | 53.7 |
| WP_138190522.1 | 2482 | 53.7 |
| WP_170089747.1 | 2483 | 53.7 |
| WP_195522634.1 | 2484 | 53.7 |
| WP_204652652.1 | 2485 | 53.7 |
| WP_214814049.1 | 2486 | 53.7 |
| WP_235315432.1 | 2487 | 53.7 |
| WP_256192134.1 | 2488 | 53.7 |
| WP_269207105.1 | 2489 | 53.7 |
| WP_270275186.1 | 2490 | 53.7 |
| WP_280378258.1 | 2491 | 53.7 |
| WP_285060750.1 | 2492 | 53.7 |
| WP_288970341.1 | 2493 | 53.7 |
| WP_294674478.1 | 2494 | 53.7 |
| WP_295219398.1 | 2495 | 53.7 |
| WP_298482140.1 | 2496 | 53.7 |
| WP_303671887.1 | 2497 | 53.7 |
| WP_304000784.1 | 2498 | 53.7 |
| WP_330222616.1 | 2499 | 53.7 |
| WP_341436196.1 | 2500 | 53.7 |
| WP_347012186.1 | 2501 | 53.7 |
| WP_347016822.1 | 2502 | 53.7 |
| WP_349202855.1 | 2503 | 53.7 |
| CCY18180.1 | 2504 | 53.7 |
| DAT44003.1 | 2505 | 53.7 |
| DAW29180.1 | 2506 | 53.7 |
| DAZ07179.1 | 2507 | 53.7 |
| HIQ93672.1 | 2508 | 53.7 |
| MBQ8133981.1 | 2509 | 53.7 |
| MBU0279366.1 | 2510 | 53.7 |
| MCH4062957.1 | 2511 | 53.7 |
| MCK9331277.1 | 2512 | 53.7 |
| MCM1168194.1 | 2513 | 53.7 |
| MCM1272176.1 | 2514 | 53.7 |
| MCR5418230.1 | 2515 | 53.7 |
| MCX4337403.1 | 2516 | 53.7 |
| NBI63475.1 | 2517 | 53.7 |
| QIW55085.1 | 2518 | 53.7 |
| WP_118524427.1 | 2519 | 53.7 |
| WP_163545681.1 | 2520 | 53.7 |
| WP_216279804.1 | 2521 | 53.7 |
| WP_295196707.1 | 2522 | 53.7 |
| WP_314073335.1 | 2523 | 53.7 |
| DAJ01384.1 | 2524 | 53.3 |
| DAS81663.1 | 2525 | 53.1 |
| HAH19201.1 | 2526 | 52.9 |
| UVN08622.1 | 2527 | 52.9 |
| WP_097025346.1 | 2528 | 52.9 |
| WP_244040559.1 | 2529 | 52.9 |
| MBR1904850.1 | 2530 | 52.8 |
| MDR3118441.1 | 2531 | 52.8 |
| WP_130806529.1 | 2532 | 52.8 |
| WP_160198836.1 | 2533 | 52.8 |
| WP_160198838.1 | 2534 | 52.8 |
| WP_221646160.1 | 2535 | 52.8 |
| WP_277142867.1 | 2536 | 52.8 |
| HBC22357.1 | 2537 | 52.8 |
| MBS7345301.1 | 2538 | 52.8 |
| MCD8297175.1 | 2539 | 52.8 |
| MCH5224281.1 | 2540 | 52.8 |
| MCM1141253.1 | 2541 | 52.8 |
| MDR2511989.1 | 2542 | 52.8 |
| MEE1113079.1 | 2543 | 52.8 |
| MEE1226274.1 | 2544 | 52.8 |
| PXY80406.1 | 2545 | 52.8 |
| WP_022400792.1 | 2546 | 52.8 |
| WP_025078191.1 | 2547 | 52.8 |
| WP_156730610.1 | 2548 | 52.8 |
| WP_195950852.1 | 2549 | 52.8 |
| DAZ34092.1 | 2550 | 52.6 |
| HEP1456418.1 | 2551 | 52.6 |
| HEP1471724.1 | 2552 | 52.6 |
| HER1886433.1 | 2553 | 52.6 |
| HER2582471.1 | 2554 | 52.6 |
| HES0462566.1 | 2555 | 52.6 |
| MBQ2659786.1 | 2556 | 52.6 |
| MBQ3271428.1 | 2557 | 52.6 |
| MBQ8429076.1 | 2558 | 52.6 |
| MBR3246619.1 | 2559 | 52.6 |
| MCI5777383.1 | 2560 | 52.6 |
| MCI9524472.1 | 2561 | 52.6 |

TABLE 7-continued

CW_7 repeat-containing protein sequences and sequence identity to CLB2 CW_7.

| GenBank | SEQ | ID % |
|---|---|---|
| MDY2598391.1 | 2562 | 52.6 |
| WP_051917032.1 | 2563 | 52.6 |
| WP_052122821.1 | 2564 | 52.6 |
| WP_111679224.1 | 2565 | 52.6 |
| WP_118584594.1 | 2566 | 52.6 |
| WP_125703673.1 | 2567 | 52.6 |
| WP_136073651.1 | 2568 | 52.6 |
| WP_136116607.1 | 2569 | 52.6 |
| WP_243091776.1 | 2570 | 52.6 |
| WP_274726326.1 | 2571 | 52.6 |
| WP_298048783.1 | 2572 | 52.6 |
| WP_304321143.1 | 2573 | 52.6 |
| AGM99860.1 | 2574 | 52.6 |
| CDD50240.1 | 2575 | 52.6 |
| DAE44343.1 | 2576 | 52.6 |
| DAI23626.1 | 2577 | 52.6 |
| DAW88811.1 | 2578 | 52.6 |
| HEL1929654.1 | 2579 | 52.6 |
| HEL1952478.1 | 2580 | 52.6 |
| HEL1991626.1 | 2581 | 52.6 |
| HEL2343545.1 | 2582 | 52.6 |
| HEM2577081.1 | 2583 | 52.6 |
| HEM2761199.1 | 2584 | 52.6 |
| HEM3013643.1 | 2585 | 52.6 |
| HEM3474618.1 | 2586 | 52.6 |
| HEM3538581.1 | 2587 | 52.6 |
| HEM3553770.1 | 2588 | 52.6 |
| HEM3657365.1 | 2589 | 52.6 |
| HEM3710124.1 | 2590 | 52.6 |
| HEM3893460.1 | 2591 | 52.6 |
| HEM4192226.1 | 2592 | 52.6 |
| HEM4699491.1 | 2593 | 52.6 |
| HEM4718477.1 | 2594 | 52.6 |
| HEM4776316.1 | 2595 | 52.6 |
| HEM4911015.1 | 2596 | 52.6 |
| HEM4919345.1 | 2597 | 52.6 |
| HEM5004686.1 | 2598 | 52.6 |
| HEM5090714.1 | 2599 | 52.6 |
| HEM5109720.1 | 2600 | 52.6 |
| HEM5119153.1 | 2601 | 52.6 |
| HEM5121716.1 | 2602 | 52.6 |
| HEM5132744.1 | 2603 | 52.6 |
| HEM5942296.1 | 2604 | 52.6 |
| HEM5978676.1 | 2605 | 52.6 |
| HEM6067931.1 | 2606 | 52.6 |
| HEM6145106.1 | 2607 | 52.6 |
| HEM6189466.1 | 2608 | 52.6 |
| HEM6250848.1 | 2609 | 52.6 |
| HEM6413220.1 | 2610 | 52.6 |
| HEM6505100.1 | 2611 | 52.6 |
| HEM6558438.1 | 2612 | 52.6 |
| KAB5638136.1 | 2613 | 52.6 |
| KAB5706536.1 | 2614 | 52.6 |
| KAB5710959.1 | 2615 | 52.6 |
| MBQ1292045.1 | 2616 | 52.6 |
| MBQ8994235.1 | 2617 | 52.6 |
| MCK3895826.1 | 2618 | 52.6 |
| MDD7566620.1 | 2619 | 52.6 |
| MDO5363071.1 | 2620 | 52.6 |
| MDW8705952.1 | 2621 | 52.6 |
| MEE0418147.1 | 2622 | 52.6 |
| NQJ93880.1 | 2623 | 52.6 |
| NQK27632.1 | 2624 | 52.6 |
| NQL21799.1 | 2625 | 52.6 |
| NQL79699.1 | 2626 | 52.6 |
| NQM31408.1 | 2627 | 52.6 |
| NQN69251.1 | 2628 | 52.6 |
| NQO20695.1 | 2629 | 52.6 |
| NQP05400.1 | 2630 | 52.6 |
| NQP14213.1 | 2631 | 52.6 |
| NQQ83748.1 | 2632 | 52.6 |
| RGV16643.1 | 2633 | 52.6 |
| WP_000290198.1 | 2634 | 52.6 |
| WP_013976664.1 | 2635 | 52.6 |
| WP_024390533.1 | 2636 | 52.6 |
| WP_024412345.1 | 2637 | 52.6 |
| WP_024414926.1 | 2638 | 52.6 |
| WP_029171101.1 | 2639 | 52.6 |
| WP_029943833.1 | 2640 | 52.6 |
| WP_029997156.1 | 2641 | 52.6 |
| WP_044675234.1 | 2642 | 52.6 |
| WP_044682843.1 | 2643 | 52.6 |
| WP_044764139.1 | 2644 | 52.6 |
| WP_044980382.1 | 2645 | 52.6 |
| WP_071126739.1 | 2646 | 52.6 |
| WP_074392165.1 | 2647 | 52.6 |
| WP_074392304.1 | 2648 | 52.6 |
| WP_099776207.1 | 2649 | 52.6 |
| WP_105095266.1 | 2650 | 52.6 |
| WP_105125678.1 | 2651 | 52.6 |
| WP_105142100.1 | 2652 | 52.6 |
| WP_105152938.1 | 2653 | 52.6 |
| WP_105159137.1 | 2654 | 52.6 |
| WP_105206431.1 | 2655 | 52.6 |
| WP_105208073.1 | 2656 | 52.6 |
| WP_105248968.1 | 2657 | 52.6 |
| WP_105257074.1 | 2658 | 52.6 |
| WP_106464647.1 | 2659 | 52.6 |
| WP_125177550.1 | 2660 | 52.6 |
| WP_141600219.1 | 2661 | 52.6 |
| WP_184493990.1 | 2662 | 52.6 |
| WP_205025891.1 | 2663 | 52.6 |
| WP_216395541.1 | 2664 | 52.6 |
| WP_226314444.1 | 2665 | 52.6 |
| WP_226943967.1 | 2666 | 52.6 |
| WP_229037239.1 | 2667 | 52.6 |
| WP_230333804.1 | 2668 | 52.6 |
| WP_240020027.1 | 2669 | 52.6 |
| WP_249549528.1 | 2670 | 52.6 |
| WP_258783994.1 | 2671 | 52.6 |
| WP_259302481.1 | 2672 | 52.6 |
| WP_270320041.1 | 2673 | 52.6 |
| WP_270544248.1 | 2674 | 52.6 |
| WP_271717875.1 | 2675 | 52.6 |
| WP_301221300.1 | 2676 | 52.6 |
| WP_301843585.1 | 2677 | 52.6 |
| WP_304068585.1 | 2678 | 52.6 |
| WP_305265450.1 | 2679 | 52.6 |
| WP_310990536.1 | 2680 | 52.6 |
| WP_311047931.1 | 2681 | 52.6 |
| WP_321058515.1 | 2682 | 52.6 |
| WP_336382927.1 | 2683 | 52.6 |
| WP_336383592.1 | 2684 | 52.6 |
| WP_336383648.1 | 2685 | 52.6 |
| WP_336384539.1 | 2686 | 52.6 |
| WP_336385566.1 | 2687 | 52.6 |
| WP_346980751.1 | 2688 | 52.6 |
| DAF84806.1 | 2689 | 52.5 |
| DAH63542.1 | 2690 | 52.5 |
| DAP70393.1 | 2691 | 52.5 |
| HCA29252.1 | 2692 | 52.5 |
| MDY2660134.1 | 2693 | 52.5 |
| WP_244034257.1 | 2694 | 52.5 |
| MBQ8042887.1 | 2695 | 51.4 |
| WP_337418624.1 | 2696 | 51.4 |
| MBN2866661.1 | 2697 | 51.4 |
| WP_276991927.1 | 2698 | 51.4 |
| WP_000215268.1 | 2699 | 51.4 |
| UGL63232.1 | 2700 | 51.4 |
| WP_044474161.1 | 2701 | 51.4 |
| MBP3855013.1 | 2702 | 51.3 |
| MBQ8042669.1 | 2703 | 51.3 |
| MCI7725402.1 | 2704 | 51.3 |
| MCW6653641.1 | 2705 | 51.3 |
| MEA4888530.1 | 2706 | 51.3 |
| WP_205422867.1 | 2707 | 51.3 |
| WP_228099272.1 | 2708 | 51.3 |
| WP_246441386.1 | 2709 | 51.3 |
| WP_278462642.1 | 2710 | 51.3 |
| DAE90652.1 | 2711 | 51.3 |

TABLE 7-continued

CW_7 repeat-containing protein sequences and sequence identity to CLB2 CW_7.

| GenBank | SEQ | ID % |
|---|---|---|
| DAH40856.1 | 2712 | 51.3 |
| DAQ98353.1 | 2713 | 51.3 |
| DAY85555.1 | 2714 | 51.3 |
| MBQ8767093.1 | 2715 | 51.3 |
| MCI7423138.1 | 2716 | 51.3 |
| MCM1277193.1 | 2717 | 51.3 |
| MDY3655021.1 | 2718 | 51.3 |
| MEE1397517.1 | 2719 | 51.3 |
| WP_276712846.1 | 2720 | 51.3 |
| WP_302194501.1 | 2721 | 51.3 |
| WP_302492296.1 | 2722 | 51.3 |
| WP_303130204.1 | 2723 | 51.3 |
| WP_336595095.1 | 2724 | 51.3 |
| AMP55868.1 | 2725 | 51.2 |
| CDA72279.1 | 2726 | 51.2 |
| DAL68036.1 | 2727 | 51.2 |
| DAP75085.1 | 2728 | 51.2 |
| DAQ78532.1 | 2729 | 51.2 |
| DAV91738.1 | 2730 | 51.2 |
| DAW02803.1 | 2731 | 51.2 |
| EKD8202267.1 | 2732 | 51.2 |
| HBA02338.1 | 2733 | 51.2 |
| HIS11692.1 | 2734 | 51.2 |
| KAI4449133.1 | 2735 | 51.2 |
| MBD5111060.1 | 2736 | 51.2 |
| MBD5112703.1 | 2737 | 51.2 |
| MBP3891536.1 | 2738 | 51.2 |
| MBP5596521.1 | 2739 | 51.2 |
| MBQ0088390.1 | 2740 | 51.2 |
| MBQ1287777.1 | 2741 | 51.2 |
| MBQ1674891.1 | 2742 | 51.2 |
| MBQ1900870.1 | 2743 | 51.2 |
| MBQ2079735.1 | 2744 | 51.2 |
| MBQ2584970.1 | 2745 | 51.2 |
| MBQ4019433.1 | 2746 | 51.2 |
| MBQ5554531.1 | 2747 | 51.2 |
| MBR6232899.1 | 2748 | 51.2 |
| MBS6584689.1 | 2749 | 51.2 |
| MCR4633162.1 | 2750 | 51.2 |
| MDB2012643.1 | 2751 | 51.2 |
| MDD6644622.1 | 2752 | 51.2 |
| MDD6708609.1 | 2753 | 51.2 |
| MDD6963734.1 | 2754 | 51.2 |
| MDO4187588.1 | 2755 | 51.2 |
| MDY2959829.1 | 2756 | 51.2 |
| MEE0186129.1 | 2757 | 51.2 |
| MEE0559652.1 | 2758 | 51.2 |
| MEE8886263.1 | 2759 | 51.2 |
| NBH27251.1 | 2760 | 51.2 |
| OCN03654.1 | 2761 | 51.2 |
| OKZ66166.1 | 2762 | 51.2 |
| OLA05444.1 | 2763 | 51.2 |
| UWI13691.1 | 2764 | 51.2 |
| WP_002593395.1 | 2765 | 51.2 |
| WP_009244112.1 | 2766 | 51.2 |
| WP_013485728.1 | 2767 | 51.2 |
| WP_114526792.1 | 2768 | 51.2 |
| WP_117704983.1 | 2769 | 51.2 |
| WP_117846743.1 | 2770 | 51.2 |
| WP_118401314.1 | 2771 | 51.2 |
| WP_122789676.1 | 2772 | 51.2 |
| WP_180703455.1 | 2773 | 51.2 |
| WP_202029995.1 | 2774 | 51.2 |
| WP_227220159.1 | 2775 | 51.2 |
| WP_249297460.1 | 2776 | 51.2 |
| WP_256305981.1 | 2777 | 51.2 |
| WP_276703428.1 | 2778 | 51.2 |
| WP_286316643.1 | 2779 | 51.2 |
| WP_286317512.1 | 2780 | 51.2 |
| WP_287937916.1 | 2781 | 51.2 |
| WP_295026378.1 | 2782 | 51.2 |
| WP_303767572.1 | 2783 | 51.2 |
| WP_303995039.1 | 2784 | 51.2 |
| WP_304428199.1 | 2785 | 51.2 |
| WP_305182534.1 | 2786 | 51.2 |
| WP_317413750.1 | 2787 | 51.2 |
| WP_330602045.1 | 2788 | 51.2 |
| WP_337781637.1 | 2789 | 51.2 |
| DAF66658.1 | 2790 | 50.0 |
| DAV12354.1 | 2791 | 50.0 |
| DAV84657.1 | 2792 | 50.0 |
| HEL1150974.1 | 2793 | 50.0 |
| HEM3538720.1 | 2794 | 50.0 |
| MBD5189010.1 | 2795 | 50.0 |
| MBD5386855.1 | 2796 | 50.0 |
| MBO5720881.1 | 2797 | 50.0 |
| MBO5799345.1 | 2798 | 50.0 |
| MBO6237701.1 | 2799 | 50.0 |
| MBO7404159.1 | 2800 | 50.0 |
| MBO7713376.1 | 2801 | 50.0 |
| MBR5533013.1 | 2802 | 50.0 |
| MCD8386023.1 | 2803 | 50.0 |
| MDE6560386.1 | 2804 | 50.0 |
| MDE6742153.1 | 2805 | 50.0 |
| NQR64229.1 | 2806 | 50.0 |
| QYA47864.1 | 2807 | 50.0 |
| RHK26519.1 | 2808 | 50.0 |
| WP_024853126.1 | 2809 | 50.0 |
| WP_025076850.1 | 2810 | 50.0 |
| WP_052327315.1 | 2811 | 50.0 |
| WP_061747786.1 | 2812 | 50.0 |
| WP_105104943.1 | 2813 | 50.0 |
| WP_105242580.1 | 2814 | 50.0 |
| WP_114866868.1 | 2815 | 50.0 |
| WP_117801139.1 | 2816 | 50.0 |
| WP_121796544.1 | 2817 | 50.0 |
| WP_135988502.1 | 2818 | 50.0 |
| WP_147525328.1 | 2819 | 50.0 |
| WP_195569855.1 | 2820 | 50.0 |
| WP_216417053.1 | 2821 | 50.0 |
| WP_219522559.1 | 2822 | 50.0 |
| WP_257713925.1 | 2823 | 50.0 |
| WP_287643461.1 | 2824 | 50.0 |
| WP_308397947.1 | 2825 | 50.0 |
| WP_332415804.1 | 2826 | 50.0 |
| DAG84186.1 | 2827 | 48.8 |
| DAL20377.1 | 2828 | 48.8 |
| DAP32509.1 | 2829 | 48.8 |
| DAQ61516.1 | 2830 | 48.8 |
| HAW06834.1 | 2831 | 48.8 |
| HBL6180668.1 | 2832 | 48.8 |
| HJI60732.1 | 2833 | 48.8 |
| MBD5113123.1 | 2834 | 48.8 |
| MBE6118020.1 | 2835 | 48.8 |
| MBO7505126.1 | 2836 | 48.8 |
| MBP5424287.1 | 2837 | 48.8 |
| MBQ1320366.1 | 2838 | 48.8 |
| MBQ3394210.1 | 2839 | 48.8 |
| MBQ9249886.1 | 2840 | 48.8 |
| MBQ9326958.1 | 2841 | 48.8 |
| MBR0373220.1 | 2842 | 48.8 |
| MBR2788889.1 | 2843 | 48.8 |
| MBR6572198.1 | 2844 | 48.8 |
| MBS5490223.1 | 2845 | 48.8 |
| MCM1166695.1 | 2846 | 48.8 |
| MCM1276394.1 | 2847 | 48.8 |
| MEE1438065.1 | 2848 | 48.8 |
| WP_118745023.1 | 2849 | 48.8 |
| WP_289262844.1 | 2850 | 48.8 |
| WP_289782850.1 | 2851 | 48.8 |
| WP_295272115.1 | 2852 | 48.8 |
| WP_295272150.1 | 2853 | 48.8 |
| DAG19090.1 | 2854 | 48.7 |
| MCI7322026.1 | 2855 | 48.7 |
| NSE26948.1 | 2856 | 48.7 |
| RHU17927.1 | 2857 | 48.7 |
| RHV75689.1 | 2858 | 48.7 |
| WP_117760751.1 | 2859 | 48.7 |
| WP_118667285.1 | 2860 | 48.7 |
| WP_173815311.1 | 2861 | 48.7 |

TABLE 7-continued

CW_7 repeat-containing protein sequences
and sequence identity to CLB2 CW_7.

| GenBank | SEQ | ID % |
|---|---|---|
| WP_270422576.1 | 2862 | 48.7 |
| WP_276692354.1 | 2863 | 48.7 |
| WP_277295283.1 | 2864 | 48.7 |
| WP_330418075.1 | 2865 | 48.7 |
| WP_330427154.1 | 2866 | 48.7 |
| DAQ15831.1 | 2867 | 48.7 |
| MBQ1319894.1 | 2868 | 48.7 |
| MBQ1320175.1 | 2869 | 48.7 |
| MBQ5561787.1 | 2870 | 48.7 |
| MCX4290136.1 | 2871 | 48.7 |
| WP_243036657.1 | 2872 | 48.7 |
| WP_243109257.1 | 2873 | 48.7 |
| WP_317413904.1 | 2874 | 48.7 |
| MBW3077678.1 | 2875 | 48.7 |
| WP_236036727.1 | 2876 | 48.7 |
| WP_332482543.1 | 2877 | 48.7 |
| WP_222759955.1 | 2878 | 48.6 |
| WP_336384256.1 | 2879 | 48.6 |
| MBQ8607098.1 | 2880 | 48.6 |
| WP_147326735.1 | 2881 | 48.6 |
| WP_260805612.1 | 2882 | 48.6 |
| WP_330006255.1 | 2883 | 48.6 |
| WP_319637130.1 | 2884 | 48.5 |
| DAG27820.1 | 2885 | 47.5 |
| DAZ53892.1 | 2886 | 47.5 |
| MBR2159883.1 | 2887 | 47.5 |
| MDD6689222.1 | 2888 | 47.5 |
| WP_150310411.1 | 2889 | 47.5 |
| HEM3698670.1 | 2890 | 47.4 |
| WP_208573214.1 | 2891 | 47.4 |
| WP_270546585.1 | 2892 | 47.4 |
| MBE6720628.1 | 2893 | 47.4 |
| WP_043025021.1 | 2894 | 47.4 |
| WP_044669030.1 | 2895 | 47.4 |
| WP_051444825.1 | 2896 | 47.4 |
| WP_183672697.1 | 2897 | 47.4 |
| DAE02510.1 | 2898 | 46.3 |
| DAL21371.1 | 2899 | 46.3 |
| DAT71827.1 | 2900 | 46.3 |
| MBN2911198.1 | 2901 | 46.3 |
| MBS4969902.1 | 2902 | 46.3 |
| MBS6597037.1 | 2903 | 46.3 |
| MCR5777246.1 | 2904 | 46.3 |
| MDD7452647.1 | 2905 | 46.3 |
| NSE04448.1 | 2906 | 46.3 |
| WP_026507130.1 | 2907 | 46.3 |
| WP_117733863.1 | 2908 | 46.3 |
| WP_171030220.1 | 2909 | 46.3 |
| WP_262122378.1 | 2910 | 46.3 |
| WP_291542845.1 | 2911 | 46.3 |
| WP_294669873.1 | 2912 | 46.3 |
| WP_320856526.1 | 2913 | 46.3 |
| DAO22718.1 | 2914 | 46.3 |
| DAQ09628.1 | 2915 | 46.3 |
| DAY85974.1 | 2916 | 46.3 |
| EFT84078.1 | 2917 | 46.3 |
| HBB46032.1 | 2918 | 46.3 |
| MBR2160169.1 | 2919 | 46.3 |
| WP_132379909.1 | 2920 | 46.3 |
| WP_223293616.1 | 2921 | 46.3 |
| WP_248623490.1 | 2922 | 46.3 |
| WP_302194304.1 | 2923 | 46.3 |
| MBF9702455.1 | 2924 | 45.9 |
| NBK97358.1 | 2925 | 45.9 |
| DAP71737.1 | 2926 | 45.7 |
| MBR5433271.1 | 2927 | 45.7 |
| WP_226557257.1 | 2928 | 45.7 |
| WP_270542317.1 | 2929 | 45.7 |
| DAP18680.1 | 2930 | 45.0 |
| DAY64203.1 | 2931 | 45.0 |
| WP_152787267.1 | 2932 | 45.0 |
| WP_286102280.1 | 2933 | 45.0 |
| WP_298535983.1 | 2934 | 44.4 |
| MBQ1325639.1 | 2935 | 43.9 |
| WP_167958494.1 | 2936 | 43.9 |
| WP_262350103.1 | 2937 | 43.9 |
| MBE7091751.1 | 2938 | 43.6 |

"GenBank": GenBank Accession No.
"SEQ": SEQ ID NO.
"ID %": Top amino acid percent identity to CLB2 CW_7 repeat among CW_7 repeats comprised by the sequence.

Chimeric Cell Wall Hydrolases of the Disclosure

In some embodiments, a recombinant protein of the disclosure is a chimeric protein. In some embodiments, a recombinant protein of the disclosure is a chimeric CWH. The present disclosure is based in part on the inventors' development of novel and highly active chimeric CWHs. As disclosed in the Examples herein, illustrative CWHs of the disclosure are surprising in that they have highly effective anti-*Cutibacterium acnes* properties that arise from the unique properties of the novel CBD and/or EAD comprised by the CWH.

In some embodiments, the present disclosure provides a recombinant protein comprising the sequence of an EAD and/or CBD according to any one of the embodiments disclosed herein. In some embodiments, the recombinant protein is a chimeric protein. In some embodiments, the chimeric protein is a chimeric cell wall hydrolase (CWH). A chimeric CWH herein comprises at least one heterologous domain, e.g., a heterologous EAD or CBD, compared to a native CWH sequence.

In some embodiments, a chimeric CWH herein is a chimeric protein comprising an EAD and a CBD from different native proteins. In some embodiments, a chimeric CWH of the disclosure comprises an EAD disclosed herein and a CBD disclosed herein. In some embodiments, a chimeric CWH of the disclosure comprises an EAD having at least 70, 75, 80, 85, 90, 95, 96, 97, 98, or 99% sequence identity with an EAD disclosed herein and a CBD having at least 70, 75, 80, 85, 90, 95, 96, 97, 98, or 99% sequence identity with a CBD disclosed herein.

In some embodiments, a chimeric CWH of the disclosure comprises a CLC1-family EAD. In some embodiments, a chimeric CWH of the disclosure comprises an EAD having at least 70, 75, 80, 85, 90, 95, 96, 97, 98, or 99% sequence identity with a CLC1-family EAD disclosed herein.

In some embodiments, a chimeric CWH of the disclosure comprises a CW_7 CBD. In some embodiments, a chimeric CWH of the disclosure comprises a CBD having at least 70, 75, 80, 85, 90, 95, 96, 97, 98, or 99% sequence identity with a CW_7 CBD disclosed herein.

In some embodiments, a chimeric CWH of the disclosure comprises a CLC1-family EAD and a CW_7 CBD. In some embodiments, a chimeric CWH of the disclosure comprises an EAD having at least 70, 75, 80, 85, 90, 95, 96, 97, 98, or 99% sequence identity with a CLC1-family EAD disclosed herein and a CBD having at least 70, 75, 80, 85, 90, 95, 96, 97, 98, or 99% sequence identity with a CW_7 CBD disclosed herein.

In some embodiments, a chimeric CWH of the disclosure comprises the EAD from CLC16 (SEQ ID NO: 35). In some embodiments, a chimeric CWH of the disclosure comprises an EAD having at least 70, 75, 80, 85, 90, 95, 96, 97, 98, or 99% sequence identity with the EAD from CLC16 (SEQ ID NO: 35).

In some embodiments, a chimeric CWH of the disclosure comprises the EAD from CLC2 (SEQ ID NO: 21). In some embodiments, a chimeric CWH of the disclosure comprises an EAD having at least 70, 75, 80, 85, 90, 95, 96, 97, 98, or 99% sequence identity with the EAD from CLC2 (SEQ ID NO: 21).

In some embodiments, a chimeric CWH of the disclosure comprises the EAD from CaLys1. In some embodiments, a chimeric CWH of the disclosure comprises an EAD having at least 70, 75, 80, 85, 90, 95, 96, 97, 98, or 99% sequence identity with the EAD from CaLys1.

In some embodiments, a chimeric CWH of the disclosure comprises the CBD from CLB2. In some embodiments, a chimeric CWH of the disclosure comprises a CBD having at least 70, 75, 80, 85, 90, 95, 96, 97, 98, or 99% sequence identity with the CBD from CLB2.

In some embodiments, a chimeric CWH of the disclosure comprises a sequence from Table 8. In some embodiments, a chimeric CWH of the disclosure consists of a sequence from Table 8. In some embodiments, a chimeric CWH of the disclosure has at least 40, 45, 50, 55, 60, 65, 70, 75, 80, 85, 90, or 95% identity with a sequence in Table 8. In some embodiments, a chimeric CWH of the disclosure has at least 80, 81, 82, 83, 84, 85, 86, 87, 88, 89, 90, 91, 92, 93, 94, 95, 96, 97, 98, or 99% identity with a sequence in Table 8. In some embodiments, the sequence of the chimeric CWH differs by 1, 2, 3, 4, 5, 6, 7, 8, 9, 10, 11, 12, 13, 14, or 15 amino acids from a sequence in Table 8.

TABLE 8

Chimeric CWHs.

| Description, SEQ ID NO | Amino Acid Sequence |
|---|---|
| CLC1-EAD + CLB1-CBD, SEQ ID NO: 52 | MTFIQARHHGGNSNTPITRLVIHATCPDVGYPSASKAGRAVSTAEYFASTSRS ASAHYVCDVSATVQCLSEETIGYHAPPNSHSIGIEICADGGSRASFEKASHAY TREQWLSPQVWPAVERAAILARGICHRHHIPVRKLTTAQVKSGMSGICGHD NVSDAFHQSDHDDPGPYFPWNEFIAAIQGKNTNKGELSMSDVTSMTGNTPA PKPAPAPAPAPNIDALADAVIRGEYGNGEERRRRLGANYAAVQKRVNEKLT GHAPAPTPNIDALADAVIRGDYGNGEERRRRLGNLYDQVQARVNQKLGY |
| CLC1-EAD + CLB2-CBD, SEQ ID NO: 53 | MTFIQARHHGGNSNTPITRLVIHATCPDVGYPSASKAGRAVSTAEYFASTSRS ASAHYVCDVSATVQCLSEETIGYHAPPNSHSIGIEICADGGSRASFEKASHAY TREQWLSPQVWPAVERAAILARGICHRHHIPVRKLTTAQVKSGMSGICGHD NVSDAFHQSDHDDPGPYFPWNEFIAAIQGKNTNKGELSMSDVTSHMTGNTP APAPAPAPKPAPTPKPAPNIDALADAVIRGEYGNGNERRRRLGSNYDAVQRRV NEKLRH |
| CLC1-EAD + CLB3-CBD, SEQ ID NO: 54 | MTFIQARHHGGNSNTPITRLVIHATCPDVGYPSASKAGRAVSTAEYFASTSRS ASAHYVCDVSATVQCLSEETIGYHAPPNSHSIGIEICADGGSRASFEKASHAY TREQWLSPQVWPAVERAAILARGICHRHHIPVRKLTTAQVKSGMSGICGHD NVSDAFHQSDHDDPGPYFPWNEFIAAIQGKNTNKGELSMSDVTSLARLDGK PSAKPAPKASAANIERLAHDVINGKFGNGDERRRRLGASYDAVQARVNQML GADAGPNIEQLANDVIAGKYGNGEARRVALGASYDAVQARVNQMLGV |
| CLC1-EAD + CLB4-CBD, SEQ ID NO: 55 | MTFIQARHHGGNSNTPITRLVIHATCPDVGYPSASKAGRAVSTAEYFASTSRS ASAHYVCDVSATVQCLSEETIGYHAPPNSHSIGIEICADGGSRASFEKASHAY TREQWLSPQVWPAVERAAILARGICHRHHIPVRKLTTAQVKSGMSGICGHD NVSDAFHQSDHDDPGPYFPWNEFIAAIQGKNTNKGELSMSDVTSAHLAGKA APAAKPATTSSPNIEQLARDVIAGGYGNGETRRAALGASYDVVQARVNQIL KAGSLAPNIEQLARDVIAGKYGNGETRRAALGASYDVVQARVNQMLGV |
| CLC2-EAD + CLB1-CBD, SEQ ID NO: 56 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSMTGNTPAPK PAPAPAPAPNIDALADAVIRGEYGNGEERRRRLGANYAAVQKRVNEKLTGH APAPTPNIDALADAVIRGDYGNGEERRRRLGNLYDQVQARVNQKLGY |
| CLC2-EAD + CLB2-CBD, SEQ ID NO: 57 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSHMTGNTPAP APAPKPAPTPKPAPNIDALADAVIRGEYGNGNERRRRLGSNYDAVQRRVNE KLRH |
| CLC3-EAD + CLB1-CBD, SEQ ID NO: 58 | MTFIQARHHGGNSNAPITRLVIHATCPDVGYPSASKAGRAVSTANYFATTDR PASAHYVCDIATTVQCLSEETIGYHAPPNSHSIGIEICADGGSHASFEKASHAY TRDQWLSDDVWPAVERAAILARDICQRHRIPVRKLSTAQVKAGLSGICGHD NVSGAFHQSDHDDPGPYFPWDQFMALVQGKPATPGDLTMADITSMTGNTP APKPAPAPAPAPNIDALADAVIRGEYGNGEERRRRLGANYAAVQKRVNEKL TGHAPAPTPNIDALADAVIRGDYGNGEERRRRLGNLYDQVQARVNQKLGY |
| CLC3-EAD + CLB2-CBD, SEQ ID NO: 59 | MTFIQARHHGGNSNAPITRLVIHATCPDVGYPSASKAGRAVSTANYFATTDR PASAHYVCDIATTVQCLSEETIGYHAPPNSHSIGIEICADGGSHASFEKASHAY TRDQWLSDDVWPAVERAAILARDICQRHRIPVRKLSTAQVKAGLSGICGHD NVSGAFHQSDHDDPGPYFPWDQFMALVQGKPATPGDLTMADITSHMTGNT PAPAPAPKPAPTPKPAPNIDALADAVIRGEYGNGNERRRRLGSNYDAVQRRV NEKLRH |

TABLE 8-continued

Chimeric CWHs.

| Description, SEQ ID NO | Amino Acid Sequence |
|---|---|
| CD27L-EAD + CLB1-CBD, SEQ ID NO: 66 | MKICITVGHSILKSGACTSADGVVNEYQYNKSLAPVLADTFRKEGHKVDVII CPEKQFKTKNEEKSYKIPRVNSGGYDLLIELHLNASNGQGKGSEVLYYSNKG LEYATRICDKLGTVFKNRGAKLDKRLYILNSSKPTAVLIESFFCDNKEDYDK AKKLGHEGIAKLIVEGVLNKNINNEGVKQMYKHTIVYDGEVDKTSMTGNTP APKPAPAPAPAPNIDALADAVIRGEYGNGEERRRLGANYAAVQKRVNEKL TGHAPAPTPNIDALADAVIRGDYGNGEERRRLGNLYDQVQARVNQKLGY |
| CD27L-EAD + CLB2-CBD, SEQ ID NO: 67 | MKICITVGHSILKSGACTSADGVVNEYQYNKSLAPVLADTFRKEGHKVDVII CPEKQFKTKNEEKSYKIPRVNSGGYDLLIELHLNASNGQGKGSEVLYYSNKG LEYATRICDKLGTVFKNRGAKLDKRLYILNSSKPTAVLIESFFCDNKEDYDK AKKLGHEGIAKLIVEGVLNKNINNEGVKQMYKHTIVYDGEVDKTSHMTGN TPAPAPAPKPAPTPKPAPNIDALADAVIRGEYGNGNERRRLGSNYDAVQRR VNEKLRH |
| PlyGVE2-EAD + CLB1-CBD, SEQ ID NO: 68 | MKKIFWDKGHGGSDPGAVANGLQEKNLTHKIVEYATDYLAAHYEGFTQRV SREGDQSLTLDQRADMANKWGADVFVSVHINAGKGTGFEIYVHPNASPQSI ALQNVLHGEILSAMRQFGNITDRGKKRANYAVLRETKMPAVLTENLFIDSN DAKHLKNEAFLKAVGEAHARGVAKFLGLKTSMTGNTPAPKPAPAPAPNI DALADAVIRGEYGNGEERRRLGANYAAVQKRVNEKLTGHAPAPTPNIDAL ADAVIRGDYGNGEERRRLGNLYDQVQARVNQKLGY |
| PlyGVE2-EAD + CLB2-CBD, SEQ ID NO: 69 | MKKIFWDKGHGGSDPGAVANGLQEKNLTHKIVEYATDYLAAHYEGFTQRV SREGDQSLTLDQRADMANKWGADVFVSVHINAGKGTGFEIYVHPNASPQSI ALQNVLHGEILSAMRQFGNITDRGKKRANYAVLRETKMPAVLTENLFIDSN DAKHLKNEAFLKAVGEAHARGVAKFLGLKTSHMTGNTPAPAPAPKPAPTPK PAPNIDALADAVIRGEYGNGNERRRLGSNYDAVQRRVNEKLRH |
| CLC4-EAD + CLB2-CBD, SEQ ID NO: 94 | MTFIQARHHGGNSNAPITRLVIHATCPDVGYPSASKAGRAVSTAEYFASTSR SASAHYVCDIAATVQCLSEEAIGFHAPPNSHSIGIEICADGGSRASFEKASHAY TREQWLSPQVWPAVERAAILARDICRRHHIPVRKLTTAQVKSGMSGICGHD NVSDAFHQSDHDDPGPYFPWNEFIAAVQGKNTNKGELSMSDVTSHMTGNT PAPAPAPKPAPTPKPAPNIDALADAVIRGEYGNGNERRRLGSNYDAVQRRV NEKLRH |
| CLC5-EAD + CLB2-CBD, SEQ ID NO: 95 | MTFIQARHHGGNSNTPVTRLVIHATCPDVGYPSASKAGRAVSTAEYFASTSR SASAHYVCDVSATVQCLSEEEAIGYHAPPNSHSIGIEICADGGSHASFETASHA YTREQWLSPQVWPAVERAAILARDICHRHHIPVRKLTTAQVKSGMSGICGH DNVSDAFRQSDHDDPGPYFPWNEFIAAVQGKTTNKGELSMSDVTSHMTGN TPAPAPAPKPAPTPKPAPNIDALADAVIRGEYGNGNERRRLGSNYDAVQRR VNEKLRH |
| CLC6-EAD + CLB2-CBD, SEQ ID NO: 96 | MTFIQARHHGGNSNNPVTRLVIHATCPDVGYPSASKAGRAVSTAQYFASTSR PASAHYVCDVSATVQCLSEETIGYHAPPNAHSIGIEICSDGGSRASFEKASHA YSREQWLSPQVWPAVERAAILARDICHRHRIPVRKLTAAQVKSGMSGICGH DNVSDAFRQSDHDDPGPYFPWNEFIAAVQGKNTNKGELSMSDVTSHMTGN TPAPAPAPKPAPTPKPAPNIDALADAVIRGEYGNGNERRRLGSNYDAVQRR VNEKLRH |
| CLC7-EAD + CLB2-CBD, SEQ ID NO: 97 | MTFIQARHHGGNSNAPITRLVIHATCPDVGYPSASKAGRAVSTAHYFAEATR PASAHYVCDVSATVQCLSEETIGYHAPPNAHSIGIEICSDGGSRASFEKASHA YSREQWLSPQVWPAVERAAILARDICHRHRIPVRKLTAAQVKSGMSGICGH DNVSDAFRQSDHDDPGPYFPWNEFIAAVQGKTTNKGELSMSDVTSHMTGN TPAPAPAPKPAPTPKPAPNIDALADAVIRGEYGNGNERRRLGSNYDAVQRR VNEKLRH |
| CLC8-EAD + CLB2-CBD, SEQ ID NO: 98 | MTFIQARHHGGNSNTPITRLVIHATCPDVGYPSASRAGRAASTANYFATTDR PASAHYVCDIATTVQCLSEEVIGFHAPPNSHSIGIEICADGGSHASFEKASHAY TREQWLSDDVWPAVERAAILARGICHRHHIPVRKLSTAQVKSGMSGICGHD NVSDAFHQSDHDDPGPHFPWNEFIAAVQGKTTNKGELSMSDVTSHMTGNTP APAPAPKPAPTPKPAPNIDALADAVIRGEYGNGNERRRLGSNYDAVQRRV NEKLRH |
| CLC9-EAD + CLB2-CBD, SEQ ID NO: 99 | MTFIQARHHGGNTNAPVTRLVIHSTCPDVGFPSASRAGRAVSTAGYFASTSR PASAHYVVDVTTTVQCLPENTIGYHAPPNSHSIGIEICSDGGSRASFENPSHA YTREQWLSPQVWPAVERAAILARGICHRHHIPVRKLTTAQVKNGMSGICGH DNVSDAFHQSDHDDPGPYFPWDKFIAAVQGKNTTSEGELSMSDITSHMTGN TPAPAPAPKPAPTPKPAPNIDALADAVIRGEYGNGNERRRLGSNYDAVQRR VNEKLRH |
| CLC10-EAD + CLB2-CBD, SEQ ID NO: | MQFIQAKHHGGNENTPVTRLVIHATCPDTGYPSASRAGRAASTARYFQSTSR PTSAHYVCDVTATVQCLSEETIGYHAPPNAHSIGIEICADGGSKSSFDNPSHS YTREQWLSPQVWPAVERAAILARDICHRHHIPVRKLSTAQVKSGMSGICGH |

TABLE 8-continued

Chimeric CWHs.

| Description, SEQ ID NO | Amino Acid Sequence |
|---|---|
| 100 | DNVSDAFHQSDHDDPGPYFPWDRFMAAITNTHPEELTMADVTSHMTGNTP APAPAPKPAPTPKPAPNIDALADAVIRGEYGNGNERRRRLGSNYDAVQRRV NEKLRH |
| CLC11-EAD + CLB2-CBD, SEQ ID NO: 101 | MTFIQAAHRGGTSNTPITRLVIHATCPDVGFPSASRAGRAVSTAEYFASTSRS ASAHYVCDISTTVQCLSEATIGYHAPPNAHSIGIEICAAGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDVTSHMTGNTP APAPAPKPAPTPKPAPNIDALADAVIRGEYGNGNERRRRLGSNYDAVQRRV NEKLRH |
| CLC12-EAD + CLB2-CBD, SEQ ID NO: 102 | MTFIQARHHGGNTNAPVSRLVIHSTCPDVGFPSASRAGRAVSTAEYFASTSR PASAHYVVDIATTVQCLPENTIGYHAPPNSHSIGIEICSDGGSRASFEKASHAY TREQWLSPQVWPAVERAAILARDICHRHRIPVRKLSTAQVKNGMSGICGHD NVSDAFHQSDHDDPGLYFPWDRFIAAIQGKNTTTKGELSMSDVTSHMTGNT PAPAPAPKPAPTPKPAPNIDALADAVIRGEYGNGNERRRRLGSNYDAVQRRV NEKLRH |
| CLC13-EAD + CLB2-CBD, SEQ ID NO: 103 | MTFIQARHHGGNTNAPVTRLVIHSTCPDVGFPSASRAGRAVSTAGYFASTSR PASAHYVVDVTTTVQCLPENTIGYHAPPNSHSIGIEICSDGGSRASFENPSHA YTREQWLSPQVWPAVERAAILARDICHRHRIPVRKLSTAQVKNGMSGICGH DNVSDAFHQSDHDDPGPYFPWDKFIAAVQGKNTTSEGELSMSDITSHMTGN TPAPAPAPKPAPTPKPAPNIDALADAVIRGEYGNGNERRRRLGSNYDAVQRR VNEKLRH |
| CLC14-EAD + CLB2-CBD, SEQ ID NO: 104 | MTFIQAKHHGGHNNPPVTRLVIHATCPDVGYPSASRAGRAVSTAHYFQETT RPASAHYICDISTTVQCLSEETVGYHAPPNSHSIGIEICADGGSHASFSNPAHA YTREQWLSPQVWPAVERAAMLARGICQRHNIPIRRLSIADVKAGKRGICGH NEVSEAFHQSDHDDPGPYFPWDGFIALVNGHSAPSRQEELTVSDVTSHMTG NTPAPAPAPKPAPTPKPAPNIDALADAVIRGEYGNGNERRRRLGSNYDAVQR RVNEKLRH |
| CLC15-EAD + CLB2-CBD, SEQ ID NO: 105 | MRYIQAKHHGGASNKPVTRLVIHSTCPDVGFPSASRAGRAESTANYFADSSR PASAHYVCDVSTTIQCLHEDVVGYHAPPNSHSIGIEICSDGGSRASFRNPNHA YTREQWLSPQVWPAVERAAVLARDICKRNGIPIRKLSTSEVKAGRSGICGHN NVSDAFHQSDHDDPGPYFPWDKFIAAVNGAKVTSEGALSMSDVTSHMTGN TPAPAPAPKPAPTPKPAPNIDALADAVIRGEYGNGNERRRRLGSNYDAVQRR VNEKLRH |
| CLC16-EAD + CLB2-CBD, SEQ ID NO: 106 | MRYIQAKHHGAASNKPVTRLVIHSTCPDVGFPSASRAGRAESTANYFADSSR PASAHYVCDVSTTIQCLHEDIVGYHAPPNSHSIGIEICSDGGSHASFNNPKHA YTRDQWLSPQVWPAVERAAVLARDICKRNGIPIRKLSTSEVKAGRSGICGHN NVSDAFHQSDHDDPGPYFPWDKFIAAVNGAKVTSEGALSMSDVTSHMTGN TPAPAPAPKPAPTPKPAPNIDALADAVIRGEYGNGNERRRRLGSNYDAVQRR VNEKLRH |
| CLC17-EAD + CLB2-CBD, SEQ ID NO: 107 | MTYIPAAHHGPTTNAPVSRIVIHSTCPDVGFPAASKAGRAVSTANYFASTSRP ASAHYVVDIATTVQCLPENTVGYHAPPNSGSIGIEICSDGGSKGSFENPAHAY TTTQWLSPEVWPAVERAAILAREICHRHHIPIRRLSVAQVRAGERGICGHNE VSEAFHRSDHDDPGPWFPWDRFILEVKGIPTEGMSMSDITSHMTGNTPAPAP APKPAPTPKPAPNIDALADAVIRGEYGNGNERRRRLGSNYDAVQRRVNEKL RH |
| CLC2-EAD + CPL1-CBD, SEQ ID NO: 224 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSAPTPPAKPT PPAPKPSVNIDALADAVIRGEYGNGDERKRRLGSNYAAVQKRVNEKLAGRS PAKPSVNIDALADAVIRGDYGNGEERKHRLGGNYAAVQKRVNEKLGIG |
| CLC2-EAD + CPL2-CBD, SEQ ID NO: 225 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSAPTPPAKPT PPAPKPSANIDALADAVIRGEYGNGDERKRRLGSNYAAVQKRVNEKLAGGS PAKPSVNIDALTDAVIRGEYGNGEERKRRLGGNYAAVQKRVNEQLGIS |
| CLC2-EAD + CPL3-CBD, SEQ ID NO: 226 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSAPTPPAKPT PPTPKPSANIDALADAVIRGEYGNGDERKRRLGSNYAAVQKRVNEKLAGGS PAKPSVNIDALADAVIRGDYGNVEERKRRLGANYAAVQKRVNEKLGIG |

TABLE 8-continued

Chimeric CWHs.

| Description, SEQ ID NO | Amino Acid Sequence |
|---|---|
| CLC2-EAD + CPL4-CBD, SEQ ID NO: 227 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSPVPKQPAKS APTPAPSVNIDALADAVIRGEYGNGNERKRRLGANYAVQKRVNEKLAGN TSKPSVNIDALADAVIRGEYGNGEERKRRLGANYAVVQARVNQKLGY |
| CLC2-EAD + CPL5-CBD, SEQ ID NO: 228 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSQKPAEPAPA PAPAPARKDIDTVAREVIAGQWGNNPQRAEKLRAAGYDANAVQARVNQM LGAPAPKPAANIDALADAVIRGDYGNGDERRRLGANYDAVQRRVNQKLG L |
| CLC2-EAD + CPL6-CBD, SEQ ID NO: 229 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSTPAKPTPTP KPAPSVPPNIDALADAVIRGEYGNGEERKRRLGANYTAVQRRVNEKLAGKK PAAKPSGPNIDALADAVIRGEYGNGEERKRRLGNLYDQVQKRVNQKLGY |
| CLC2-EAD + CPL7-CBD, SEQ ID NO: 230 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSTGTTPTPKP QPTPTPAANIDALADAVIRGDYGNGNERKRRLGANYAAVQKRVNEKLAGG SPSKPSANIDALADSVIRGDYGNGDERRRLGENYVAVQARVNQKLGY |
| CLC2-EAD + CPL8-CBD, SEQ ID NO: 231 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSAPTPPAKPT PPAPKPSANIDALADAVIRGEYGNGEERKRRLGANYTAVQKRVNEKLTGGS PAKPSANIDALADAVIRGEYGNGEERKRRLGGNYAAVQKRVNEKLGIG |
| CLC2-EAD + CPL9-CBD, SEQ ID NO: 232 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSTGTTPTPKP QPAPAPAPNIDALADAVIRGDYGNGNERKRHLGANYAAVQKRVNEKLAGN TSKPSVNIDALADAVIRGEYGNGEERKRRLGANYDAVQARVNQKLGY |
| CLC2-EAD + CPL10-CBD, SEQ ID NO: 233 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSSGKTPAPTA KSASTPSTDIDALADAVIRGEYGNGGERKQRLGANYTAVQKRVNEKLSGAA PAKPDGPNIDALADAVIRGEYGNGDERKQRLGNLYSAVQARVNQKLG |
| CLC2-EAD + CPL11-CBD, SEQ ID NO: 234 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSMTGNTPAPA PAPAPAAPNIDALADAVIRGEYGNGDERKRRLGANYAAVQQRVNEKLLGN APATKPAGPNIDALADAVIRGEYGNGEERKRRLGNLYGAVQARVNVKLGY |
| CLC2-EAD + CPL12-CBD, SEQ ID NO: 235 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSSGTKPAPAP KPTPAPTPNIDALADAVIRGEYGNGDERRRLGNLYDQVQRRVNEKLAGKK PAPKPAPNIDALADAVIRGEYGNGDERRRLGSLYDQVQRRVNQKLGY |
| CLC2-EAD + CPL13-CBD, SEQ ID NO: 236 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSAPTPPAKPT PPAPKPSVNIDALADAVIRGEYGNGEERKRRLGSNYAAVQKRVNEKLTG GNPNKPSVNIDALADAVIRGDYGNGEERKRRLGGNYAAVQKRVNEKLGIS |
| CLC2-EAD + CPL14-CBD, SEQ ID NO: | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE |

TABLE 8-continued

Chimeric CWHs.

| Description, SEQ ID NO | Amino Acid Sequence |
|---|---|
| 237 | VSEAFHQSDHDDPGPYFPWNEFIAAVQGKTTTPEGELSMSDTSDQMTGTKP<br>APAPAAPSVNIDTFADAVIRGEYGNGDERKRRLGANYAAVQARVNEKLAG<br>KAKPAGKSIETLAREVIRGDWGNGQERYNRLTNAGYNYQQVQNRVNQILN |
| CLC2-EAD + CPL15-CBD, SEQ ID NO: 238 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSYDQISGNKP<br>QAASASKPDIEALANAVIRGEYGNGDQRRARLGGLYDAVQRRVNEKLAAG<br>SAPAAPNIDALADAVIRGDYGNGATRRARLGNLYNQVQARVNQKLGC |
| CLC2-EAD + CPL16-CBD, SEQ ID NO: 239 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSKTAAAASVS<br>KPAASKGPNYEALADAVIRGEYGSGEERMRRLGNAYARVQAIVNARLLGG<br>QPTPTPLPAKPAGANIDALAKAVIRGEYGTGDARRQKLGNLYDQVQARVNQ<br>ILGAGATAHRAGANIDALADAVIRGEYGNGDERRVRLGANFAAVQARVNQ<br>KLAA |
| CLC2-EAD + CPL18-CBD, SEQ ID NO: 240 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSPAPAKPSPA<br>KPAPSTPPNIDALADAVIHGDYGNGEERKRRLGSNHAAVQKRVNEKLAGKK<br>PAVKPAGPNIDALADAVIRGGYGNGDERKRRLGGLYAQVQKRVNQKLGY |
| CLC2-EAD + CPL20-CBD, SEQ ID NO: 241 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSGAGGAASA<br>SPAPTVPSPDIDALAREVIAGKYGNGDDRRRALGANYGRVQARVNEILGAG<br>ARPHSQVVDVDALARAVIRGEFGNGEERKRRLGANYAAVQRRVNELLS |
| CLC2-EAD + CPL21-CBD, SEQ ID NO: 242 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSGGGGNGRS<br>ASGVDSPSGDLNALADAVLRGDYGNGDERKRRLGSKYSAVQAIVNQRLGY<br>GSTPVSSGPDLNALADAVIRGEYGNGDERRRLGANYKAVQALVNKKLGY |
| CLC2-EAD + CPL22-CBD, SEQ ID NO: 243 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSERVETGVAA<br>ENCPDGSTANLAAAVMRGEYGNGDERRKRLGSRYDEVQALINRVSSSSVDD<br>LAKDVLNGVFGNGDTRRAVLGSRYDEVQARVNARSSSVDIDALARAVIRGE<br>YGDGNERRTKLGANFDAVQKRVNELLK |
| CLC2-EAD + CPL23-CBD, SEQ ID NO: 244 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSTGGGSSGGT<br>TSAAPGGTVAELARRVIAGEFGNGDARRAALGSRYDEVQAEVNRILAGGSG<br>GGAAQAPAADDVDDLARRVIAGEFGNGAARKAALGSRYAEVQARVNEML<br>GAGGSGGPSGGADVDALAHAVIRGDYGNGAERKRRLGSLYDAVQARVNEI<br>LS |
| CLC2-EAD + CPL24-CBD, SEQ ID NO: 245 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSRVDGKPAPA<br>IKPSSSSSNLDQLADDVLTGKYGNGDERRRRLGASYDAVQARVNQMLSVKS<br>SAPNIDQLADDVINGKYGNGDERRRLGASYDAVQARVNQKLGVR |
| CLC2-EAD + CPL25-CBD, SEQ ID NO: 246 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSGGSSSSAPS<br>GGSAPSGSATDLAKRVIAGEFGNGDARKAALGSRYDEVQAEVNRILNGGSS<br>SSPSVDIDQMARDVIAGKYGNGDARKAALGSNYDAVQARVNELLGAGGSA<br>TGGADIDALARAVIRGEYGNGEERKRRLGSMYEAVQARVNELL |
| CLC2-EAD + CPL26-CBD, | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY |

TABLE 8-continued

Chimeric CWHs.

| Description, SEQ ID NO | Amino Acid Sequence |
|---|---|
| SEQ ID NO: 247 | TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSFGAAAGGG<br>NGGSAPSGSVAELAQAVIRGDYGNGDARRGALGSRYDEVQAEVNRILGGGS<br>ASGGSSSGGSGADIEALAQAVIRGDYGNGDARRAALGSAYDAVQARVNEIL<br>GAGGSSSGGSGGADIEALAQAVIRGEYGNGDERRHRLGSLYDAVQARVNEI<br>LL |
| CLC2-EAD + CPL28-CBD, SEQ ID NO: 248 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSDVGGAPGG<br>SGSGAPSGDVSELAERVIAGEFGNGDARRAALGSRYDEVQAEVNRILGGGS<br>GIDVDAMARRVIAGEFGNGDERKRRLGSNYDAVQRRVNEILLGAGSSSTSM<br>DIDAMARAVIRGDYGNGEERRRRLGSYYSIVQSRVNEMLS |
| CLC2-EAD + CPL29-CBD, SEQ ID NO: 249 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSGGSGSGGS<br>GGPAPSGDVSELARRVINGEFGNGDVRKAALGSSYSAVQTRVNEMLGCGSS<br>GGGSGSAGVDIDALARAVINGDYGNGEERRQRLGANYAAVQRRVNEMLS |
| CLC2-EAD + CPL30-CBD, SEQ ID NO: 250 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSRVNEILGCG<br>PSASGAASNVDALAHAVINGDYGNGEARRERLGADYEAVQRRVNELLA |
| CLC2-EAD + CPL31-CBD, SEQ ID NO: 251 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSEPYISGANA<br>VIDTIDDLSIDKLADAVISGKYGSGAERRTRLGQRYDAVQQRVNEKLAKAK<br>LSSSAENPERKAPPKPVPAENSGKDSVVGTSPTGDLEELAAAVIQGKYGNGA<br>ERRARLGDRYQEVQNLVNRKLSS |
| CLC2-EAD + CPL32-CBD, SEQ ID NO: 252 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSDVGSASTPT<br>GSGAPSGDVSELAARVIAGDFGNGDARRAALGSRYDEVQAEVNRILSGGSSS<br>GSYDVDALARRVIAGEFGNGDDRKRRLGDRYSTVQKRVNEILGASGASSTS<br>MDVDAMARAVIRGDYGNGEERRRRLGSYYSIVQRRVNEMLS |
| CLC2-EAD + CPL33-CBD, SEQ ID NO: 253 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSAPARPASQP<br>AANSSGSSNLEALADAVIAGKYGNGEARRKALGANYAAVQAIVNRKLGAG<br>GSTSVDLNALADAVIRGDYGNGQERKRRLGANYAAVQALVNKKLGY |
| CLC2-EAD + CPL34-CBD, SEQ ID NO: 254 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSGGAVASQP<br>APVPSTGGVDINALADAVLRGEYGNGAERRARLGGLYDAVQAVVNQKLGA<br>TGATRGAGVDINALADGVLKGLYGNGAERRQRLGVHYDAVQAEVNRRLG<br>Y |
| CLC2-EAD + CPL35-CBD, SEQ ID NO: 255 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSAGVPSAHKP<br>PAASAPGGSVDELARAVLAGRYGNGEERKRRLGARYGEVQRRVNELIAGK<br>APAPSAPNLDALANAVLRGEYGNGEERRRRLGSLYQPVQDLVNRKLGIR |
| CLC2-EAD + CPL36-CBD, SEQ ID NO: 256 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSYITGGSPA<br>APAPSVGGDIEALAQAVICGEYGNGEDRKARLGHLYDAVQARVNAKLSGS<br>APAPAPGPNLDALADAVIRGDYGNGAERRNRLGHLYDAVQAIVNRKLS |
| CLC2-EAD + CPL38-CBD, | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY |

TABLE 8-continued

Chimeric CWHs.

| Description, SEQ ID NO | Amino Acid Sequence |
|---|---|
| SEQ ID NO: 257 | TREQWLSPQVWPAVERAAILARDICHRHHIPIRRLSVAQVRAGERGICGHNE<br>VSEAFHQSDHDDPGYFPWNEFIAAVQGKTTTPEGELSMSDTSGGASAPAA<br>KPQQSTPAVNIDDLARRAIAGEFGNGDERKAKLGGNYAAVQQRVNEMLGQ<br>GGGSSAPSVDLNALADAVIRGDYGNGEERKRRLGGNYAAVQQLVNRKLGY |
| CLC2-EAD + CPL39-CBD, SEQ ID NO: 258 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSGGVPAAVK<br>PPAPTAAGGSVDELARAVIAGKYGNGDERRRLGNRYGEVQARVNELISGK<br>KPAPKPANLDAIANAVLRGEYGNGDERRRLGNLYQPVQDLVNRKLGIR |
| CLC2-EAD + CPL40-CBD, SEQ ID NO: 259 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSSATKQPVDA<br>VSSTTTATDIEEKAKSVIRGEFGNGQERKKRLGSDYSEVQKKVNEIYSKGKS<br>KSK |
| CLC2-EAD + CPL43-CBD, SEQ ID NO: 260 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSLCGKTAAPV<br>EPEAPAKPTIDELAQEVLTGKWGNGSERKQRLEAAGHDYAAVQRRVNEILS<br>GNAPGEPTTPPTSEELTAAEIDALARAVIRGDYGNGVTRRAKLGSKYAAVQ<br>KRVNEILRG |
| CLC2-EAD + CPL44-CBD, SEQ ID NO: 261 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSATVPTPTPST<br>PPVAGKTVWQLADEVLAGHHGSGDDRKISLGIQYDAVQAEINRRYGVVVV<br>APAEKTVSQLADEVLAGHGNGEQRRASLGNRFDEVQNEINRRLGGGGVA<br>PQGLNIAQLADAVMRGEYGSGQDRINRLGANYDAVQQEVNRRLGGNASPV<br>ANINALADAVLRGEYGNGDERVRRLGANYAAVQAEINRRYA |
| CLC2-EAD + CPL45-CBD, SEQ ID NO: 262 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSNKVSGVSTS<br>KPSKPKSKSIDQLADEVIKGLHGSGAQRKNSLGSQYDAVQKRVNEKLLGSQ<br>PKPKPATKSIDQLVKETLAGKHGNGEARKKSLGKNYKAVQDIINGKSSAPK<br>KTDSKPKTLKVGQKV |
| CLC2-EAD + CPL46-CBD, SEQ ID NO: 263 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSAVAPAATPA<br>TPPPTKGKTVWQLADEVLAGHHGSGDARKASLGAQYDAVQAEVNRRLGAG<br>TAAPKVKTISQLADEVIAGKHGTGAARQKSLGNQYTAVQNEINRRLGGGGV<br>APQGVNISALADRVLRGEFGSGDARVKALGKNYAAVQAEVNRRLGGGKAA<br>SAPKRVVNISALADAVIRGEYGSGEDRKRRLGANYAAVQAEVNRRYS |
| CLC2-EAD + CPL49-CBD, SEQ ID NO: 264 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSPWLGSSAST<br>PAAPPSGDLNALADAVLRGEYGNGDERKRRLGSNYAAVQAIVNQKLGAGS<br>APAPAPAAPAVDLNALADAVIRGEYGNGDDRRNRLGANYDAVQNLVNRKL<br>QGAPAAGPDLNALADAVIRGEYGNGDERKRRLGANYAAVQALVNRKLR |
| CLC2-EAD + CPL50-CBD, SEQ ID NO: 265 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSQTEPSPAVT<br>PSASPSIDLEAEAAKVIRGDYGNGDERRARLGDNYRAVQNVVNRMLAQ |
| CLC2-EAD + CPL51-CBD, SEQ ID NO: 266 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGYFPWNEFIAAVQGKTTTPEGELSMSDTSAPAPAPTPA<br>PAPTPSGSIDDLAQRVINGEFGNGDARKAALGDKYDAVQARVNEMLGVGG<br>GSHAPSPTPATDIDDLARRVINGEFGNGDARKAALGSKYDAVQARVNEMLG<br>CGGGGGSTSVDIDTLAWKVINGDYGNGQARRDALGDLYDRVQARVNELL |

TABLE 8-continued

Chimeric CWHs.

| Description, SEQ ID NO | Amino Acid Sequence |
|---|---|
| CLC2-EAD + CPL52-CBD, SEQ ID NO: 267 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSAVGNAAAA ASTDVSAATIDAEARR VIHGDFGNGAQRKAALGSHYAAVQQRVNELLHV |
| CLC2-EAD + CPL53-CBD, SEQ ID NO: 268 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSATVPVTPSE LDATNSTSIEELAREVIRGTWGNGNERYQRLTAAGFDYDAVQARVNELVGI ASKPANKNIDRLAREVIRGDWGNGQERYNRLTAAGYDYHTVQARVNQLLA |
| CLC2-EAD + CPL54-CBD, SEQ ID NO: 269 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSGSTAPTAKP APAPEKKTVETLADEVIKGLWGNGEERKRRLTASGYSYDAVQKKVNERLSV KPKKSINTLAREVIHGDWGNGNERKNRLTKAGYNYDAVQKRVNELL |
| CLC2-EAD + CPL55-CBD, SEQ ID NO: 270 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSISKSTSTSDK PKTDGKSIDQLADEVIAGKHGYGDARKKALGSQYDAVQKRVNEKLGSKPK KSSKSIDTLVKETLAGKHGNGEARKKSLGSNYEAVMDVINGKASKPKKSVS QMATEVIQGKHGFGHENRRKSLGISKTEYEKVRKEVNKRL |
| CLC2-EAD + CPL56-CBD, SEQ ID NO: 271 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSTSNNSSNSK KKPSKNKSIDQLAQEVIAGKYGTGASRKKALGSQYDAVQKRVNEILLGDKP KSSGKSINQMATEVIQGKHGNGHANRRKSLGISQSEYEKVRSEVNRRL |
| CLC2-EAD + CPL59-CBD, SEQ ID NO: 272 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSDANGNSVY PVESAPSKSVDTLAREVIAGNWGNGQDRVNRLTSAGYNYNSVQNRVNEILS GVSNKPSGKSIDTLAREVIRGDWGNGQDRKNRLERAGYDYDAVQKRVNEL L |
| CLC2-EAD + CPL60-CBD, SEQ ID NO: 273 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSDANGRSVYP VASTPSKSIDALAREVIAGNWGNGQYRVNRLRSAGYDYDAVQNRVNEILSG KSSSQSGGKSIDTLAREVIRGDWGNGQDRKNSLERAGYDYNAVQRRVNELL |
| CLC2-EAD + CPL61-CBD, SEQ ID NO: 274 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSEIKNVIANV ETPQITDSIEDLANEVIAGKYGNGEERKQLGSSYDEVQRRVNEILLGKDSST NTNEELAKEVIEGKWGNNPERKQRLLEAGYDYEAIQKIVNQRLK |
| CLC2-EAD + CPL62-CBD, SEQ ID NO: 275 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSKRLGLNGFE KTDGEKADIDKIAREVIRGEWGNGEERKERLKKAGYSYEEVQNRVNELLSE DKKSIDEIANEVIRGEWGNGEERKKRLRDAGYDYDAVQKRVNEKIG |
| CLC2-EAD + CPL63-CBD, SEQ ID NO: 276 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSKGNVVYPK AQPAPTKKSVDEIAREVIRGDWGNSDRTKRLSAAGYDANAVQNRVNEILG GSSTPKKSIDEVAHEVIRGEWGNGADRKNRLIAAGYNYDAVQKRVNEIL |
| CLC2-EAD + CPL64-CBD, SEQ ID NO: 277 | MTFIQAAHRGGTSNTPITRLVIHATCPDVGFPSASRAGRAVSTAEYFASTSRS ASAHYVCDISTTVQCLSEATIGYHAPPNAHSIGIEICADGGSRASFEKASHAY TREQWLSPQVWPAVERAAILARDICHRHHIPIRRLSVAQVRAGERGICGHNE VSEAFHQSDHDDPGPYFPWNEFIAAVQGKTTTPEGELSMSDTSVKPTPAPAP |

TABLE 8-continued

Chimeric CWHs.

| Description, SEQ ID NO | Amino Acid Sequence |
|---|---|
| | KPEPAKKSVDEIAREVIAGKWGAGEERKKLLTSAGYDYNAVQNKVNEILYD<br>PKPQPPKKSIDQIAREVIRGDWGAGEERRKRLTAAGYDYDAVQKRVNEILY<br>G |
| CLC2-EAD +<br>CPL65-CBD,<br>SEQ ID NO:<br>278 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSYIIENGLNG<br>YPKKPEKTLDELARDVIRGDWGNGEERYERLTEAGYDYDAVQKRVNEILYP<br>PLKPLDEVAREVIRGDWGNGEERYRRLTEAGYDYYQVQRKVNEILYN |
| CLC2-EAD +<br>CPL66-CBD,<br>SEQ ID NO:<br>279 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSSSDTAPGGG<br>STPSVSGTIDELARRVIAGEFGSGDTRKNALGDKYGAVQARVNEILNGTASA<br>PAKKSVSEIAKEVLAGAWGNGDARKQKLEAAGYNYSEVQAKVNSLASGSS<br>SSVDIDALARRVIAGEFGSGDARKKALGSNYDAVQKRVNEMLGGSSSSVNY<br>AAIAKEVINGKWGNGAARKKKLEAAGYNYNKVQKEVNKLL |
| CLC2-EAD +<br>CPL68-CBD,<br>SEQ ID NO:<br>280 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSLGTGSAAST<br>QPNAATGSIDDLAKRTIAGEFGNGDQRRAALGANYDAVQARVNEILGGGSS<br>SQPAVFDVDAAARDVIAGKYGNGDQRRTALGSHYDEVQARVNQMLGAAA<br>STSVNIDAEARKVIRGDYGNGGERRNALVAKFGANVANQIQTRVNDLLR |
| CLC2-EAD +<br>CPL69-CBD,<br>SEQ ID NO:<br>281 | MTFIQAAHRGGTSNTPITRLVIHATCPDVGFPSASRAGRAVSTAEYFASTSRS<br>ASAHYVCDISTTVQCLSEATIGYHAPPNAHSIGIEICADGGSRASFEKASHAY<br>TREQWLSPQVWPAVERAAILARDICHRHHIPIRRLSVAQVRAGERGICGHNE<br>VSEAFHQSDHDDPGPYFPWNEFIAAVQGKTTTPEGELSMSDTSVYDEQGVLI<br>YPKTNNKSIDELAREVINGLWGNGSDRKNKLISASYDYDAVQNRVNEILDG<br>GKATPSKSIDTLAKEVIRGDWGNGADRKKRLTAAGYNYDAVQKRVNQILG |
| CLC1-EAD +<br>CLB1-CW7-1-<br>CBD, SEQ ID<br>NO: 2942 | MTFIQARHHGGNSNTPITRLVIHATCPDVGYPSASKAGRAVSTAEYFASTSRS<br>ASAHYVCDVSATVQCLSEETIGYHAPPNSHSIGIEICADGGSRASFEKASHAY<br>TREQWLSPQVWPAVERAAILARGICHRHHIPVRKLTTAQVKSGMSGICGHD<br>NVSDAFHQSDHDDPGPYFPWNEFIAAIQGKNTNKGELSMSDVTSPNIDALAD<br>AVIRGEYGNGEERRRRLGANYAAVQKRVNEKLTG |
| CLC1-EAD +<br>CLB1-CW7-2-<br>CBD, SEQ ID<br>NO: 2943 | MTFIQARHHGGNSNTPITRLVIHATCPDVGYPSASKAGRAVSTAEYFASTSRS<br>ASAHYVCDVSATVQCLSEETIGYHAPPNSHSIGIEICADGGSRASFEKASHAY<br>TREQWLSPQVWPAVERAAILARGICHRHHIPVRKLTTAQVKSGMSGICGHD<br>NVSDAFHQSDHDDPGPYFPWNEFIAAIQGKNTNKGELSMSDVTSPNIDALAD<br>AVIRGDYGNGEERRRRLGNLYDQVQARVNQKLGY |

In some embodiments, a chimeric CWH of the disclosure comprises the amino acid sequence of SEQ ID NO: 106. In some embodiments, a chimeric CWH of the disclosure consists of the amino acid sequence of SEQ ID NO: 106. In some embodiments, a chimeric CWH of the disclosure has at least 40, 45, 50, 55, 60, 65, 70, 75, 80, 85, 90, or 95% identity with the amino acid sequence of SEQ ID NO: 106. In some embodiments, a chimeric CWH of the disclosure has at least 80, 81, 82, 83, 84, 85, 86, 87, 88, 89, 90, 91, 92, 93, 94, 95, 96, 97, 98, or 99% identity with the amino acid sequence of SEQ ID NO: 106. In some embodiments, the sequence of the chimeric CWH differs by 1, 2, 3, 4, 5, 6, 7, 8, 9, 10, 11, 12, 13, 14, or 15 amino acids from the amino acid sequence of SEQ ID NO: 106.

Linkers

In some embodiments, a chimeric protein herein comprises more than one domain, and the domains are joined by a linker. In some embodiments, the linker is a flexible linker. In some embodiments, the linker is an amino acid sequence between 1-100 amino acids in length, including all values and subranges therebetween. In some embodiments, the linker comprises one or more glycines and/or serines. Persons having ordinary skill in the art will be familiar with other linkers that can be used in the chimeric proteins of the present disclosure.

Protein Tags

In some embodiments, a recombinant protein of the disclosure comprises a protein tag. A protein tag is typically a short sequence of amino acids, or a protein domain, that is fused to a recombinant protein in order to facilitate purification and/or visualization. In some embodiments, a protein tag improves protein solubility. In some embodiments, the tag is a His tag, a GST tag, an MBP tag, a Strep tag, a FLAG tag, a GFP tag, an HA tag, a V5 tag, an Avi tag, a CBP tag, a ZZ tag, a SUMO tag, an Fc tag, a Thioredoxin tag, a Protein kinase A (PKA) tag, a Myc tag, or an S tag, or any combination thereof. In some embodiments, the tag is a His tag and comprises 6 histidine residues.

Nucleic Acids, Vectors, and Host Cells of the Disclosure

The present disclosure also provides nucleic acids encoding the recombinant proteins, e.g., CWHs, of the disclosure. The present disclosure also provides vectors and host cells for expression of the recombinant proteins of the disclosure. In some embodiments, the vector is a plasmid, a cosmid, a bacteriophage, or a virus comprising a nucleic acid of the disclosure. In some embodiments, the host cell comprises a nucleic acid of the disclosure or a vector of the disclosure. In some embodiments, the host cell is a bacterial cell, a yeast cell, an insect cell, a mammalian cell, or a plant cell.

Formulations of the Disclosure

The present disclosure provides compositions comprising the recombinant proteins disclosed herein. The present disclosure provides compositions comprising the EADs, enzymes, truncated enzymes, CBDs, chimeric CWHs, nucleic acids, vectors, and host cells disclosed herein. In some embodiments, these compositions are formulated for delivery to a subject for the treatment of a condition associated with *Cutibacterium acnes*.

Topical, Parenteral, and Enteral Formulations

In some embodiments, compositions of the disclosure are formulated for topical, parenteral, or enteral administration.

In some embodiments, a composition herein is formulated for topical administration. Formulations for topical administration include lotions, hydrogels, creams, ointments, gels, drops, transdermal patches, colloidal patches, powders, suppositories, sprays, liquids, semi-solids, monophasic compositions, multiphasic compositions (e.g., oil-in-water, water-in-oil), foams, microsponges, liposomes, nanoemulsions, aerosol foams, polymers, fullerenes, and powders. In some embodiments, carriers, bases, thickeners, penetration enhancers, buffers, diluents, emulsifiers, humectants, dispersing aids, binders, and/or excipients are added to the formulation. In some embodiments, the composition is formulated as a hydrogel. In some embodiments, the composition is formulated as a lotion. In some embodiments, the composition is formulated as a cream. In some embodiments, the composition is formulated as a freeze dried powder, e.g., which can be reconstituted with liquid prior to use. In some embodiments, the composition is a colloidal patch. In some embodiments, the composition is formulated as a colloidal patch. In some embodiments, the composition is formulated as a microneedle patch.

In some embodiments, the compositions of the disclosure are formulated for parenteral administration. As used herein, "parenteral administration" of a composition includes any route of administration characterized by physical breaching of a tissue of a subject and administration of the composition through the breach in the tissue, thus generally resulting in the direct administration into the blood stream, into muscle, or into an internal organ. Parenteral administration thus includes, but is not limited to, administration of a composition by injection of the composition, by application of the composition through a surgical incision, by application of the composition through a tissue-penetrating non-surgical wound, and the like. In particular, parenteral administration is contemplated to include, but is not limited to, subcutaneous, intraperitoneal, intramuscular, intrasternal, intravenous, intraarterial, intrathecal, intraventricular, intraurethral, intracranial, intratumoral, intrasynovial injection or infusions; and kidney dialytic infusion techniques.

In some embodiments, a composition herein is prepared for oral administration. The terms "oral", "enteral", "enterally", "orally", "non-parenteral", "non-parenterally", and the like, refer to administration of a compound or composition to an individual by a route or mode along the alimentary canal. Examples of "oral" routes of administration of a composition include, without limitation, swallowing liquid or solid forms of a composition from the mouth, administration of a composition through a nasojejunal or gastrostomy tube, intraduodenal administration of a composition, and rectal administration, e.g., using suppositories for the lower intestinal tract of the alimentary canal. The compositions of the present disclosure may be formulated into any of many possible dosage forms such as, but not limited to, tablets, capsules, liquid syrups, soft gels, suppositories, aerosols, and enemas. The compositions of the present disclosure may also be formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers.

Formulation Ingredients

In some embodiments, the composition comprises an emulsifier. In some embodiments, the composition comprises a mixture of emulsifiers. In some embodiments, the composition comprises about 0.5% to about 5% w/v of an emulsifier or a mixture of emulsifiers.

Examples of emulsifiers suitable for use in some embodiments of the disclosure include xanthan gum, polysorbate 80, oleoyl polyoxyl-6 glycerides, polyoxyl 35 hydrogenated castor oil, sucrose distearate, saponin, sodium alginate, guar gum, tocopherol polyethylene glycol 1000 succinate, lauroyl polyoxyl-32 glycerides, sorbitan monooleate, glyceryl stearate, cetearyl alcohol, sodium stearoyl lactylate, salts thereof, derivatives thereof, and mixtures thereof. In some embodiments, the emulsifier is xanthan gum.

In some embodiments, emulsifier components are selected from poly-glycolized glycerides and polyoxyethylene glycerides of medium to long chain mono-, di-, and triglycerides, such as: almond oil PEG-6 esters, almond oil PEG-60 esters, apricot kernel oil PEG-6 esters (Labrafil® M1944CS), caprylic/capric triglycerides PEG-4 esters (Labrafac® Hydro WL 1219), caprylic/capric triglycerides PEG-4 complex (Labrafac® Hydrophile), caprylic/capric glycerides PEG-6 esters (Softigen® 767), caprylic/capric glycerides PEG-8 esters (Labrasol®), castor oil PEG-50 esters, hydrogenated castor oil PEG-5 esters, hydrogenated castor oil PEG-7 esters, 9 hydrogenated castor oil PEG-9 esters, corn oil PEG-6 esters (Labrafil® M 2125 CS), corn oil PEG-8 esters (Labrafil® WL 2609 BS), corn glycerides PEG-60 esters, olive oil PEG-6 esters (Labrafil® M1980 CS), hydrogenated palm/palm kernel oil PEG-6 esters (Labrafil® M 2130 BS), hydrogenated palm/palm kernel oil PEG-6 esters with palm kernel oil, PEG-6, palm oil (Labrafil® M 2130 CS), palm kernel oil PEG-40 esters, peanut oil PEG-6 esters (Labrafil® M 1969 CS), glycerol esters of saturated C8-C18 fatty acids (Gelucire® 33/01), glyceryl esters of saturated C12-C18 fatty acids (Gelucire® 39/01 and 43/01), glyceryl laurate/PEG-32 laurate (Gelucire® 44/14), glyceryl laurate glyceryl/PEG 20 laurate, glyceryl laurate glyceryl/PEG 32 laurate, glyceryl, laurate glyceryl/PEG 40 laurate, glyceryl oleate/PEG-20 glyceryl, glyceryl oleate/PEG-30 oleate, glyceryl palmitostearate/PEG-32 palmitostearate (Gelucire® 50/13), glyceryl stearate/PEG stearate, glyceryl stearate/PEG-32 stearate (Gelucire® 53/10), saturated polyglycolized glycerides (Gelucire® 37/02 and Gelucire® 50/02), triisostearin PEG-6 esters (i.e. Labrafil® Isostearique), triolein PEG-6 esters, trioleate PEG-25 esters, polyoxyl 35 castor oil (Cremophor® EL or Kolliphor® EL), polyoxyl 40 hydrogenated castor oil (Cremophor® RH 40 or Kolliphor® RH40), polyoxyl 60 hydrogenated castor oil (Cremophor® RH60), lecithin, phospholipids and mixtures thereof.

In some embodiments, the emulsifier is polyglycolized derivatives and polyoxyethylene esters or ethers derivatives of medium to long chain fatty acids, commercially named Brij and Myrj variety surfactants, and propylene glycol esters of medium to long chain fatty acids, which can be used including caprylate/caprate diglycerides, glyceryl monooleate, glyceryl ricinoleate, glyceryl laurate, glyceryl dilaurate, glyceryl dioleate, glyceryl mono/dioleate, glyceryl caprylate/caprate, medium chain (C8/C10) mono- and diglycerides (Capmul® MCM, Capmul® MCM (L)), mono- and diacetylated monoglycerides, polyglyceryl oleate, polyglyceryl-2 dioleate, polyglyceryl-10 trioleate, polyglyceryl-10 laurate, polyglyceryl-10 oleate, and polyglyceryl-10 mono dioleate, propylene glycol caprylate/caprate (Labrafac® PC), propylene glycol dicaprylate/dicaprate (Miglyol® 840), propylene glycol monolaurate, propylene glycol ricinoleate, propylene glycol monooleate, propylene glycol dicaprylate/dicaprate, propylene glycol dioctanoate, and mixtures thereof.

In some embodiments, the composition comprises a humectant. In some embodiments, the composition is a topical formulation and comprises a humectant, which can be referred to as a soothing, smoothing, moisturizing, or protective agent. Humectants of the present disclosure function to stabilize the moisture content of the tissue to which it is applied in the presence of fluctuating humidity.

In some embodiments, the humectant is selected from: polyglycols (as hereinafter defined), propylene glycol, sorbitol, lactic acid, sodium lactate, glycerol, glycerine, ethoxylated castor oil, calamine, dodecylsulphate, sodium lauryl sulphate (SLS); a polyoxyethylene ester of polysorbitan, such as monooleate, monolaurate, monopalmitate, monostearate esters; esters of sorbitan, the polyoxyethylenes ethers, sodium dioctylsulphosuccinate (DOSS), lecithin, sodium docusate, hexylene glycol, butylene glycol, aloe vera gel, aloe vera powder, hyaluronic acid, alpha hydroxy acids such as lactic acid, egg yolk, egg white, glyceryl triacetate, honey, molasses, polymeric polyols such as polydextrose, quillaia, sodium hexametaphosphate e452i; sugar alcohols (sugar polyols) such as glycerol, sorbitol, xylitol, maltitol; urea, and castor oil.

In some embodiments, the composition comprises a humectant selected from the list consisting of: aloe vera, betaine, butylene glycol, caprylyl glycol, dimethicone, fructose, glucomannan, glucose, glycerin, glyceryl glucoside, honey, hyaluronic acid, lactic acid, panthenol, polyethylene glycol, propylene glycol, propanediol, sodium hyaluronate, sodium lactate, sodium pyrrolidone carboxylic acid, sorbitol, and urea. In some embodiments, the composition comprises 0.1-50% w/v humectant, including all values and subranges therebetween. In some embodiments, the composition comprises 0.5-10% w/v humectant.

In some embodiments, the composition comprises hyaluronic acid. In some embodiments, the composition is a hyaluronic-based hydrogel for topical application. In some embodiments, the composition comprises 0.1-10% w/v hyaluronic acid. In some embodiments, the composition comprises 0.5-5.0% w/v hyaluronic acid. In some embodiments, the composition comprises 1-2% w/v hyaluronic acid. In some embodiments, the composition comprises a hydrogel. In some embodiments, the hydrogel comprises a cellulose polymer. In some embodiments the hydrogel comprises hydroxypropyl methylcellulose.

In some embodiments, the composition comprises a cellulose polymer. In some embodiments, the cellulose polymer is hydroxyethyl cellulose, methylcellulose, hydroxy methylcellulose, carboxymethyl cellulose, microcrystalline cellulose, ethyl cellulose, sodium carboxymethyl cellulose, hydroxypropyl cellulose, or cellulose acetate. In some embodiments, the composition comprises 0.1-20% w/v cellulose polymer, including all values and subranges therebetween. In some embodiments, the composition comprises 0.5-10% w/v of a cellulose polymer. In some embodiments, the composition comprises 1-5% w/v of a cellulose polymer. In some embodiments, the composition comprises hydroxypropyl methylcellulose (HPMC). In some embodiments, the composition comprises 0.5-10% w/v of HPMC. In some embodiments, the composition comprises 1-5% w/v HPMC.

In some embodiments, the composition comprises a thickening agent, a gelling agent, and/or a polymer. In some embodiments, the composition comprises an acrylate. In some embodiments, the composition comprises a carbomer.

In some embodiments, the composition comprises a salt. In some embodiments, the composition comprises a salt selected from the list consisting of: calcium chloride, Dead Sea salt, Epsom salt, Himalayan pink salt, magnesium chloride, sea salt, and sodium chloride. In some embodiments, the composition comprises 10-500 mM of a salt, including all values and subranges therebetween. In some embodiments, the composition comprises 50-250 mM of a salt.

In some embodiments, the composition comprises a buffer. In some embodiments, the buffer is 4-(2-hydroxyethyl)-1-piperazineethanesulfonic acid, acetic acid, ammonium acetate, boric acid, citric acid, glycine, phosphoric acid, potassium hydroxide, potassium phosphate, sodium acetate, sodium bicarbonate, sodium borate, sodium carbonate, sodium citrate, sodium dihydrogen phosphate, sodium hydrogen phosphate, sodium hydroxide, sodium phosphate, sodium tetraborate, tris(hydroxymethyl)aminomethane, or trisodium phosphate. In some embodiments, the composition comprises 1-250 mM of a buffer, including all values and subranges therebetween. In some embodiments, the composition comprises 5-50 mM of a buffer.

In some embodiments, the composition comprises a surfactant. In some embodiments, the composition comprises a surfactant selected from the list consisting of: ceteareth-20, cocamidopropyl betaine, coco-glucoside, decyl glucoside, decyl polyglucose, disodium laureth sulfosuccinate, glycereth-26, lauryl glucoside, lauryl polyglucose, sodium cocoyl glutamate, sodium cocoyl isethionate, sodium laureth sulfate, and sodium lauryl sulfate. In some embodiments, the composition comprises 0.1-20% w/v of a surfactant, including all values and subranges therebetween. In some embodiments, the composition comprises 1-10% w/v of a surfactant.

In some embodiments, the composition comprises an oil. In some embodiments, the composition comprises an oil selected from the list consisting of: argan oil, avocado oil, baobab oil, camellia oil, carrot seed oil, coconut oil, evening primrose oil, grapeseed oil, hemp seed oil, jojoba oil, macadamia nut oil, marula oil, mineral oil, olive oil, pomegranate seed oil, raspberry seed oil, rosehip seed oil, squalane oil, sunflower seed oil, sweet almond oil, and tamanu oil. In some embodiments, the composition comprises 0.1-20% w/v of an oil, including all values and subranges therebetween.

In some embodiments, the composition comprises an alcohol. In some embodiments, the composition comprises an alcohol selected from the list consisting of: cetyl alcohol, ethyl alcohol, isopropyl alcohol, and stearyl alcohol. In some embodiments, the composition comprises 0.1-20% w/v of an alcohol, including all values and subranges therebetween. In some embodiments, the composition comprises 1-10% w/v of an alcohol.

In some embodiments, the composition comprises a free amino acid. In some embodiments, the composition comprises alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, or valine. In some embodiments, the composition comprises an amino acid selected from the list consisting of: alanine, arginine, cysteine, glutamine, glycine, histidine, lysine, methionine, proline, serine, and threonine. In some embodiments, the composition comprises 10-250 mM of an amino acid, including all values and subranges therebetween. In some embodiments, the composition comprises 25-150 mM of an amino acid.

In some embodiments, the composition comprises glycerol. In some embodiments, the composition comprises 0.5-50% w/v glycerol, including all values and subranges therebetween. In some embodiments, the composition comprises 1-30% w/v glycerol. In some embodiments, the composition comprises 1-5% w/v glycerol.

In some embodiments, the composition comprises petrolatum. In some embodiments, the composition comprises 0.1-20% w/v petrolatum, including all values and subranges therebetween.

The compositions of the present disclosure can comprise an additional agent or agents, whether active or passive. Examples of such an agent include a sweetening agent, a flavoring agent, a coloring agent, a filling agent, a binding agent, a lubricating agent, an excipient, a preservative, an emollient, a hydrating agent, a smoothing agent, or a manufacturing agent. Additional excipients or additives can be added to the composition. For example, if desired, any generally accepted soluble or insoluble inert filler (diluent) material can be included in the final product (e.g., a solid dosage form). Such inert filler can comprise a monosaccharide, a disaccharide, a polyhydric alcohol, inorganic phosphates, sulfates or carbonates, and combinations thereof. Examples of suitable inert fillers include sucrose, dextrose, lactose, xylitol, fructose, sorbitol, calcium phosphate, calcium sulfate, calcium carbonate, microcrystalline cellulose, and combinations thereof. An effective amount of any generally accepted lubricant, such as calcium or magnesium soaps, can be added.

Depending on the dosage form, optional additives and modifiers further comprise one or more of acids, bases, acidity regulators, alcohol, anticaking agents, antifoaming agents, antioxidants, bulking agents, coagulation agents, colour retention agents, emulsifiers, flavor enhancers, flour treatment agents, gelling agents, glazing agents, humectants, leavening agents, tracer gases, preservatives, stabilizers, sweeteners, tenderizers, and thickeners.

The compositions of the present disclosure may additionally contain other conventional adjunct components. Thus, for example, the compositions may contain additional, compatible, active materials such as, for example, antipruritics, astringents, local anesthetics or anti-inflammatory agents, or may contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

In some embodiments, the composition comprises a skin protectant. In some embodiments, the composition comprises an FDA-approved skin protectant. In some embodiments, the composition comprises colloidal oatmeal. In some embodiments, the composition comprises a skin protectant selected from the list consisting of allantoin, aluminum hydroxide gel, calamine, cocoa butter, cod liver oil, colloidal oatmeal, dimethicone, glycerin, hard fat, kaolin, lanolin, mineral oil, petrolatum, sodium bicarbonate, topical starch, white petrolatum, zinc acetate, zinc carbonate, and zinc oxide. In some embodiments, the composition comprises any one of the following skin protectants in the following ranges: allantoin, 0.5 to 2%; aluminum hydroxide gel, 0.15 to 5%; calamine, 1 to 25%; cocoa butter, 50 to 100%; cod liver oil, 5 to 13.56%; colloidal oatmeal, 0.007% minimum, or 0.003% minimum in combination with mineral oil; dimethicone, 1 to 30%; glycerin, 20 to 45%; hard fat, 50 to 100%; kaolin, 4 to 20%; lanolin, 12.5 to 50%; mineral oil, 50 to 100%, or 30 to 35% in combination with colloidal oatmeal; petrolatum, 30 to 100%; sodium bicarbonate; topical starch, 10 to 98%; white petrolatum, 30 to 100%; zinc acetate, 0.1 to 2%; zinc carbonate, 0.2 to 2%; zinc oxide, 1 to 25%. See, e.g., Sec. 347.10 of CFR Title 21, Volume 5, "Skin protectant active ingredients," incorporated by reference herein in its entirety.

In some embodiments, the composition comprises an ingredient that is FDA-approved for the treatment of acne. In some embodiments, the composition comprises Aklief (trifarotene), Arazlo (tazarotene), Avita (tretinoin) Gel and Cream, Benzamycin (erythromycin 3%-benzoyl peroxide 5% topical gel), Cabtreo (clindamycin phosphate, adapalene, and benzoyl peroxide) topical gel, Estrostep Fe (Norethindrone Acetate and Ethinyl Estradiol, USP and Ferrous Fumarate), Retin-A Micro (tretinoin gel) 0.06% and 0.08%, Seysara (sarecycline), Tazorac (tazarotene) gel and cream 0.05% and 0.1% Veltin (clindamycin phosphate and tretinoin), or Winlevi (clascoterone). In some embodiments, the composition comprises trifarotene, tazarotene, tretinoin, erythromycin, benzoyl peroxide, clindamycin phosphate, adapalene, norethindrone acetate, ethinyl estradiol, ferrous fumarate, sarecycline, and/or clascoterone.

In some embodiments, other ingredients are also present in the composition, such as antibiotics; antiseptics; antifungals; corticosteroids; soothing agents; anti-aging agents; smoothing agents; moisturizing agents; and protective agents. In some embodiments, the composition comprises an antibiotic.

Characteristics of Compositions of the Disclosure

The present disclosure provides chimeric proteins, as well as compositions comprising these chimeric proteins. These compositions have beneficial characteristics for therapeutic use against target *Cutibacterium acnes*.

In addition to issues with selectivity, prior CWHs and endolysins known in the art have properties that are not well-suited for therapeutic indications, e.g., topical application. For example, the previously characterized CWHs suffer from weak activity, low thermostability, low solubility, and/or narrow or unsuitable pH range.

The present disclosure provides chimeric CWHs with beneficial characteristics, such as, but not limited to, high anti-*Cutibacterium acnes* activity, *Cutibacterium acnes* species specificity, thermostability, solubility, and broader or more suitable pH range.

Anti-*Cutibacterium acnes* Activity

In some embodiments, compositions of the present disclosure are active against *Cutibacterium acnes* species. In some embodiments, a composition of the disclosure has activity against *Cutibacterium acnes* and the degree of that activity is determined based on its Minimum Inhibitory Concentration (MIC) against that target species. In some embodiments, the MIC is less than 100, 90, 80, 70, 60, 50, 40, 30, 20, or 10 µg/mL. In some embodiments, the MIC is less than 20, 19, 18, 17, 16, 15, 14, 13, 12, 11, 10, 9, 8, 7, 6, 5, 4, 3, 2, or 1 µg/mL. In some embodiments, the MIC is less than 5.0, 4.5, 4.0, 3.5, 3, 0, 2.5, 2.0, 1.5, 1.0, or 0.5 µg/mL. In some embodiments, the MIC is less than 1.0, 0.9, 0.8, 0.7, 0.6, 0.5, 0.4, 0.3, 0.2, or 0.1 µg/mL.

In some embodiments, a composition of the disclosure has activity against *Cutibacterium acnes* at a concentration of less than 50 µg/mL. In some embodiments, a composition of the disclosure has activity against *Cutibacterium acnes* at a concentration of less than 40, 30, 20, or 10 µg/mL. In some embodiments, a composition of the disclosure has activity against *Cutibacterium acnes* at a concentration of 50 µg/mL. In some embodiments, a composition of the disclosure has activity against *Cutibacterium acnes* at a concentration of 24 µg/mL. In some embodiments, a composition of the disclosure has activity against *Cutibacterium acnes* at a concentration of 12 µg/mL. In some embodiments, a composition of the disclosure has activity against *Cutibacterium acnes* at a concentration of 6 µg/mL.

In some embodiments, a composition of the disclosure is active against one or more different phylotypes of *Cutibacterium acnes*. In some embodiments, a composition of the disclosure is active against phylotype IA1. In some embodiments, a composition of the disclosure is active against phylotype IA2. In some embodiments, a composition of the disclosure is active against phylotype IA1, IA2, IB, II, and/or III. In some embodiments, a composition of the disclosure is active against phylotypes IA1, IA2, IB, and II.

Selectivity

The present inventors discovered that illustrative novel chimeras disclosed herein exhibited remarkable selective activity for *Cutibacterium acnes* over other bacterial species. As known in the art, the only CWH previously known in the art to exhibit lytic activity against *C. acnes* (CaLys1) also exhibits similar lytic activity towards other strains of bacteria, which is highly undesirable for a topical skin microbiome application. By contrast, illustrative chimeric CWHs of the present disclosure are able to distinguish between *C. acnes* and commensal skin bacteria.

In some embodiments, a recombinant protein of the disclosure shows specificity for *Cutibacterium acnes* over other species. In some embodiments, a recombinant protein of the disclosure shows specificity for *Cutibacterium acnes* over commensal bacterial species. In some embodiments, a recombinant protein of the disclosure shows specificity for *Cutibacterium acnes* over *Corynebacterium xerosis*, *Corynebacterium striatum*, and/or *Staphylococcus epidermidis*.

In some embodiments, a recombinant protein of the disclosure has at least 2, 3, 4, 5, 6, 7, 8, 9, or 10-fold selectivity. In some embodiments, a recombinant protein of the disclosure has at least 5, 10, 15, 20, 25, 30, 35, 40, 45, 50, 55, 60, 65, 70, 75, 80, 85, 90, 95, or 100-fold selectivity. In some embodiments, a recombinant protein of the disclosure has virtually no activity (or no detectable activity) against one species, while having measurable activity against *C. acnes*.

In some embodiments, a composition of the disclosure has broad range anti-*Cutibacterium acnes* activity. In some embodiments, the composition has high activity against multiple strains of *Cutibacterium acnes*. In some embodiments, the composition has high activity against a group of related *Cutibacterium acnes* strains. In some embodiments, the composition has high activity against a diverse group of *Cutibacterium acnes* strains. In some embodiments, the composition is suitable for use as a broad-range therapeutic.

Thermostability

The inventors of the present disclosure also surprisingly discovered that some of the novel chimeric CWHs of the disclosure exhibited desirable high thermostability.

In some embodiments, a composition of the disclosure exhibits thermostability at temperatures up to 37, 38, 39, 40, 41, 42, 43, 44, 45, 46, 47, 48, 49, 50, 51, 52, 53, 54, 55, 56, 57, 58, 59, or 60° C., including all values and ranges therebetween. In some embodiments, a composition of the disclosure exhibits thermostability at temperatures of at least 37, 38, 39, 40, 41, 42, 43, 44, 45, 46, 47, 48, 49, 50, 51, 52, 53, 54, 55, 56, 57, 58, 59, or 60° C., including all values and ranges therebetween.

As used herein, thermostability at a given temperature refers to the ability to maintain activity levels at that temperature, or after the protein is exposed to that temperature. In some embodiments, thermostability at a given temperature is measured after exposure to that temperature for a period of time. In some embodiments, thermostability is determined based on experiments testing activity at a temperature or after exposure to a given temperature for a period of time (e.g., showing measurable target bacterial density reductions at that temperature or after exposure to that temperature). Thus, in some embodiments, an EAD, CBD, or chimeric protein is considered thermostable at a temperature if it still exhibits measurable activity at that temperature or after exposure to that temperature. In some embodiments, an EAD, CBD, or recombinant chimeric protein is considered thermostable at a critical temperature, if it still exhibits measurable activity at its intended use temperature after being exposed to that critical temperature (e.g., activity tested after the protein is exposed to the critical temperature for 30 mins). In some embodiments, thermostability after exposure to a given temperature is determined based on assays conducted at room temperature. In some embodiments, thermostability is determined after exposure to a given temperature based on an assay that measures activity. In some embodiments, the assay is a turbidity reduction assay.

In the context of comparing two proteins (e.g., two EADs, two CBDs, or two chimeric CWHs), one protein may be considered more thermostable at a given temperature than the other if it exhibits higher absolute activity at that temperature or after exposure to that temperature (e.g., if it results in greater microbial density reductions in the measured time). In other embodiments, one protein may be considered more thermostable than the other at a given temperature if it exhibits higher relative activity at that temperature or after exposure to that temperature (e.g., if the protein exhibits a lesser reduction in activity after exposure to a given temperature compared to the relative reduction of activity of a second protein after exposure to that same temperature).

In some embodiments, thermostability at a given temperature is determined based on ability to maintain activity after exposure to that temperature for 10, 20, 30, 40, 50, or 60 minutes, including all values and ranges therebetween. In some embodiments, thermostability at a given temperature is determined after exposure to that temperature for 1, 2, 3, 4, 5, 6, 7, 8, 9, 10, 11, 12, 13, 14, 15, 16, 17, 18, 19, 20, 21, 22, 23, or 24 hours, including all values and ranges therebetween. In some embodiments, thermostability at a given temperature is determined after exposure to that temperature for 1, 2, 3, 4, 5, 6, or 7 days, including all values and ranges therebetween. In some embodiments, thermostability at a given temperature is determined after exposure to that temperature for 1, 2, 3, or 4 weeks, including all values and ranges therebetween. In some embodiments, thermostability at a given temperature is determined after exposure to that temperature for 1, 2, 3, 4, 5, or 6 months, including all values and ranges therebetween.

In some embodiments, thermostability is measured based on testing activity after maintaining a composition at a given temperature for a period of time, e.g., weeks or months. In some embodiments, thermostability is determined based on activity retained after 2 months at a given temperature.

In some embodiments, a composition herein is thermostable at 45° C. for at least four weeks. In some embodiments, a composition herein is thermostable at 45° C. for at least two months. In some embodiments, a composition herein is thermostable at 50° C. for at least two months.

In some embodiments, a composition herein is considered thermostable or shelf stable if it retains at least 10, 20, 30, 40, 50, 60, 70, 80, or 90% of its original activity, including all values and ranges therebetween, at room temperature after exposure to a temperature of 45° C. for four weeks.

pH Range

In some embodiments, a composition herein is stable at a range of pH values. A composition, e.g., a chimeric protein, is considered stable at a given pH level if it exhibits activity at that pH level. In some embodiments, pH stability at different pH values is determined based on activity assays conducted at different pH values. E.g., in some embodiments, pH stability is determined by incubating a composition of the disclosure (e.g., a chimeric protein) with target bacterial cells at different pH values (e.g., in a turbidity reduction assay). The results of the assay provide activity levels for the composition at different pH values, including a maximum activity level. In some embodiments, a composition is stable at a pH level if it has the same activity at that pH as its maximum activity level. In some embodiments, a composition is stable at a pH level if it exhibits at least 50, 60, 70, 80, 90, 95, 96, 97, 98, or 99% of its maximum activity at that pH. In some embodiments, a composition is stable at a pH level if it exhibits about 50, 60, 70, 80, 90, 95, 96, 97, 98, or 99% of its maximum activity at that pH.

In some embodiments, pH stability is determined based on an activity assay. In some embodiments, the assay is a turbidity reduction assay.

In some embodiments, a composition herein is stable at a pH of 3, 4, 5, 6, 7, 8, 9, or 10, or within any ranges therebetween. In some embodiments, a composition herein is stable in the pH range of 6-8. In some embodiments, a composition herein is stable in the pH range of 5-8. In some embodiments, a composition herein is stable at pH values most relevant for topical skin applications. E.g., in some embodiments, a composition herein is stable at a pH of 4, 5, or 6.

Synergy

In some embodiments, the present disclosure provides a combination composition comprising at least two compositions, e.g., chimeric proteins, of the disclosure. In some embodiments, at least two compositions of the disclosure are administered together. In some embodiments, two compositions of the disclosure are administered one after the other or simultaneously. In some embodiments, a combination composition of the disclosure exhibits synergistic results compared to the constituent compositions individually.

As used herein, the term "synergistic" as it refers to a composition of the disclosure, refers to a composition that exhibits an effect (y) that is in excess of the predicted effect of the composition as calculated by a reference model. In some embodiments, "synergistic" refers to an effect that is greater than a simple additive effect. In some embodiments, a synergistic combination is one for which the MIC of the combination is lower than the MIC for its constituent components. In some embodiments, a synergistic combination is one for which the MIC of the combination is lower than the MIC for its constituent components, as calculated by percent composition. In some embodiments, a composition is said to have synergistic effects if it exhibits more than the additive properties of its individual ingredients.

Methods of Treating *Cutibacterium acnes* Conditions

The present disclosure provides methods of treating conditions associated with *Cutibacterium acnes* comprising administering a composition of the disclosure.

A composition as disclosed herein may be used to treat subjects affected by a condition associated with a *Cutibacterium acnes* species as defined herein. In some embodiments, the subject is an animal. In some embodiments, the animal is a mammal. In some embodiments, the subject is a human.

Conditions

In some embodiments, a composition of the disclosure is used in the treatment of a condition associated with *Cutibacterium acnes*. In some embodiments, the condition is Acne vulgaris (acne).

In some embodiments, the condition is associated with the skin. In some embodiments, the condition is a skin infection. In some embodiments, the condition is impetigo, cellulitis, folliculitis, atopic dermatitis, acute radiation dermatitis, acne, or an abscess.

In some embodiments, the condition is a wound infection, pneumonia, food poisoning, toxic shock syndrome, a bloodstream infection, pneumonia, a urinary tract infection, a bone or joint infection (e.g., osteomyelitis, septic arthritis), endocarditis, meningitis, septicemia, an ear infection (e.g., otitis externa), an eye infection (e.g., conjunctivitis, keratitis), a sinus infection, gastroenteritis, mastitis, peritonitis, a prosthetic joint infection, a sternal wound infection, a catheter-related infection, or tonsillitis. In some embodiments, the condition is an infection of the skin. In some embodiments, the condition is an infection of the soft tissue. In some embodiments, the condition is an opportunistic infection. In some embodiments, the condition is a wound infection. In some embodiments, the condition is a chronic wound. In some embodiments, the condition is Acne Vulgaris, skin infection, cellulitis, orthopedic infection, endophthalmitis, prosthetic valve endocarditis, otitis media, or osteomyelitis. In some embodiments, the condition is an inflammatory lesion. In some embodiments, the condition is a comedone (pimple), papule, pustule, nodule, or cyst. In some embodiments, the condition is skin redness, swelling, pain, tenderness, or abnormal texture. In some embodiments, the condition is a psychosocial condition associated with Acne Vulgaris.

In some embodiments, the condition is the presence of *Cutibacterium acnes* species (especially over-abundance of phylotype $IA_1$) on the skin.

Dosages

In some embodiments, a composition of the disclosure comprises 0.1-100 µg/mL of a recombinant protein, e.g., a chimeric protein, disclosed herein. In some embodiments, the composition comprises 0.5-50 µg/mL of a recombinant protein of the disclosure. In some embodiments, the composition comprises 1-25 µg/mL of a recombinant protein of the disclosure. In some embodiments, the composition comprises 2-15 µg/mL of a recombinant protein of the disclosure.

In some embodiments, a composition of the disclosure comprises about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 µg/mL of a protein of the disclosure.

Administration

For the purposes of administration, the present compositions may be formulated in a variety of forms. The term "dosage form" denotes any form of the formulation that contains an amount of a chimeric protein of the disclosure sufficient to achieve at least a partial therapeutic effect with a single or repeat administration. In some embodiments, the dosage form is a topical dosage form. In some embodiments, the dosage form is a lotion, an oil, a gel, a salve, or a body balm. In some embodiments, the dosage form is a lotion.

Compositions can be formulated in forms including but not limited to liquid, gel, semi-solid, and solid. Compositions disclosed herein can further be processed into forms including but not limited to solids, liquids, suspensions, gels, lotions, balms, and other forms discussed in this disclosure.

In some embodiments, an effective amount of a composition is administered to a subject. The term "effective amount" or "therapeutically effective amount" refers to that amount of a composition described herein that is sufficient to effect the intended application including but not limited to a decrease in a *Cutibacterium acnes* population. The therapeutically effective amount may vary depending upon the subject and condition being treated, e.g., the weight and age of the subject, the severity of the disease condition, the manner of administration and the like, which can readily be determined by one of ordinary skill in the art. The term also applies to a dose that will induce a particular response in a target location, e.g., a reduction in inflammation, pain, acne, fever, etc. The specific dose will vary depending on the particular formulation of the composition, the dosing regimen to be followed, whether it is administered in combination with other compounds, timing of administration, the tissue to which it is administered, route of administration and the physical delivery system in which it is carried.

In some embodiments, a composition as disclosed herein is said to be active, functional or therapeutically active or able to treat, prevent and/or delay a condition associated with *Cutibacterium acnes* when it reduces or ameliorates one or more symptoms associated with that condition. In some embodiments, a composition is considered therapeutically active when it decreases a symptom by at least 5, 10, 15, 20, 25, 30, 35, 40, 45, 50, 55, 60, 65, 70, 75, 80, 85, 90, 95, 96, 97, 98, 99, or 100% after treatment compared to the severity of that symptom before treatment. In some embodiments, the symptom is pain, fever, swelling, redness, dry skin, lesion number, lesion size, rash, warmness, drainage, discharge, cough, shortness of breath, rapid heart rate, low or high blood pressure, chills, nausea, vomiting, diarrhea, stomach cramps, chest pain, or organ failure.

In some embodiments, a composition herein is therapeutically active when it decreases the amount of a target *Cutibacterium acnes* species present in a subject or in an in vitro system and preferably means that 99%, 90%, 80%, 70%, 60%, 50%, 40%, 30%, 20%, 10%, 5% or less of the initial amount of a *Cutibacterium acnes* species, is still detectable after treatment. In some embodiments, no *Cutibacterium acnes* species is detectable after treatment. Herein, the expression "amount of *Cutibacterium acnes* species" refers to living *Cutibacterium acnes* species. In some embodiments, *Cutibacterium acnes* species are detected using sequencing techniques, such as 16S sequencing or shotgun sequencing, to quantify the amount of different *Cutibacterium acnes* species present in a sample, as well as evaluating species present in the overall microbiome in question. Living *Cutibacterium acnes* species may be detected using standard techniques known by the artisan such as microbiological bacterial culture techniques and/or real-time quantitative reverse transcription polymerase chain reaction to assay for bacterial mRNA. In some embodiments, said decrease is assessed in a tissue or in a cell of an individual or a patient by comparison to the amount present in said individual or patient before treatment with a composition disclosed herein. In some embodiments, the comparison is made with a tissue or cell of said individual or patient which has not yet been treated with the composition as disclosed herein in case the treatment is local.

A composition as disclosed herein may be administered to a subject in need thereof or to a cell, tissue or organ or said patient for at least one day, one week, one month, six months, one year or more.

Accordingly, there is provided a composition as disclosed herein, for use by a subject in need thereof. In some embodiments, the composition is use as a medicament in the prevention, delay or treatment of a condition in a subject, wherein the condition is associated with *Cutibacterium acnes*.

Further provided is the composition as disclosed herein for systemic or local administration to the subject.

In some embodiments, local administration is employed locally at the site of a condition or infection, or in association with surgery, or at the site of an implant. The medical use disclosed herein may be formulated as a product as disclosed herein for use as a medicament for treatment of the stated conditions but can equally be formulated as a method of treatment of the stated conditions using a product as disclosed herein, a product as disclosed herein for use in the preparation of a medicament to treat the stated conditions and use of a product as disclosed herein for the treatment of the stated conditions. Such medical uses are all envisaged by the present disclosure. The subject in need of treatment, delay and/or prevention of the listed conditions may be any animal subject, preferably a mammal, more preferably cattle, domestic animals like a dog or a cat, or a human subject.

Further provided is the in vitro use of a composition as disclosed herein or a nucleic acid construct as disclosed herein, or an expression construct as disclosed herein, or a host cell as disclosed herein, as an antimicrobial or as a disinfectant.

Further provided is the use of a composition as disclosed herein or a nucleic acid construct as disclosed herein, or an expression construct as disclosed herein, or a host cell as disclosed herein, or a composition as disclosed herein, for binding and/or detecting *Cutibacterium acnes*, in an ex vivo diagnostic application.

EXAMPLES

Summary Table for Examples of the Disclosure

| # | Description |
|---|---|
| | I. Examples 1-4: Novel Cutibacterium Endolysins |
| 1 | Identification of novel family of endolysins containing amidase domains in *Cutibacterium* sp. |
| 2 | CLC1 protein displays high solubility and significant anti-*C. acnes* lytic activity. |
| 3 | CLC1-truncation exhibits improved solubility and lytic activity compared to full length protein. |
| 4 | Removal of C-terminal regions of other CLC1-family proteins and CaLys1 also improves solubility and activity. |
| | II. Examples 5-7: Novel *C. acnes* Cell Wall Binding Domains |
| 5 | Identification of novel CLBD1-CLBD4 as putative cell wall hydrolases from *Cutibacterium* sp. and *Propionimicrobium* sp. containing CW_7 cell wall binding domains. |
| 6 | Identification of large family of CBDs with broad taxonomical diversity comprising CW_7 repeats. |
| 7 | CLB1-CBD and CLB2-CBD can target chimeric cell wall hydrolases against C. acnes. |
| | III. Examples 8-21: Novel CLC1-family EAD and CW_7 CBD chimeras |
| 8 | Chimeras comprising CLC1-3 EADs in combination with CLB1-4 CBDs exhibit anti-*C. acnes* activity. |
| 9 | Chimeric proteins comprising CLC1-family EADs and CW_7 CBDs display lytic activity across a broad range of pH values. |
| 10 | Chimeric proteins comprising CLC1-family EADs and CW_7 CBDs display strong selectivity for C. acnes. |
| 11 | Chimeric proteins comprising CLC1-family EADs and CW_7 CBDs display significant thermostability. |
| 12 | Quantitative killing assay demonstrates significant *C. acnes* lytic activity by the CLC1-EAD + CLB1-CBD chimera. |
| 13 | Chimeric CWHs comprising the broader CLC1 family of EADs in combination with CLB2 CBD exhibit lytic activity against *C. acnes*. |
| 14 | Chimeric CWHs comprising CLC1-family EADs and CLB2 CBD exhibit significant thermostability. |
| 15 | CLC16 EAD + CLB2 CBD chimera exhibits strong selectivity for *C. acnes* over commensal skin bacteria. |
| 16 | CLC1-EAD + CLB2-CBD and CLC16-EAD + CLB2-CBD chimeric enzymes are active against a broad panel of Cutibacterium acnes strains and phylotypes. |
| 17 | The CBD from CLB2 increases the enzymatic activity of the CaLys1 EAD. |
| 18 | Diverse CW_7 repeats are able to facilitate binding and lysis of C. acnes in chimeric CWHs in whole cell lysate screen. |
| 19 | Actinobacteria, viral, and Firmicute CW_7 CBDs facilitate binding and lysis of *C. acnes* in chimeric CWHs in turbidity reduction assays. |
| 20 | Single CW_7 repeat sufficient for increasing anti-*C. acnes* activity in chimeric combination with CLC1-family EAD. |
| 21 | Topical hydrogel formulations of chimeric proteins retained strong lytic activity against *C. acnes*. |

I. Examples 1-4: Novel *Cutibacterium* Endolysins

Example 1: Identification of Novel CLC1-Family of Endolysins Containing Amidase Domains in *Cutibacterium* sp Previous attempts to identify endolysins that target *C. acnes* have focused exclusively on searching the genomes of *C. acnes* phages or *C. acnes* strains containing prophages. However, this approach had only identified a single well-conserved endolysin, as exemplified by the protein sequence NCBI accession ID: YP_006907103.1, referred to as CaLys1 in this application (SEQ ID NO: 72).

Bioinformatic analysis was conducted in broader *Cutibacterium* species in order to identify novel endolysins that target *C. acnes*. Without wishing to be bound by any particular theory, it is hypothesized that putative endolysins and cell wall hydrolases found within the genomes of broader *Cutibacterium* sp. and phages that infect broader *Cutibacterium* sp. may also have activity against *C. acnes*.

Figure 1B:
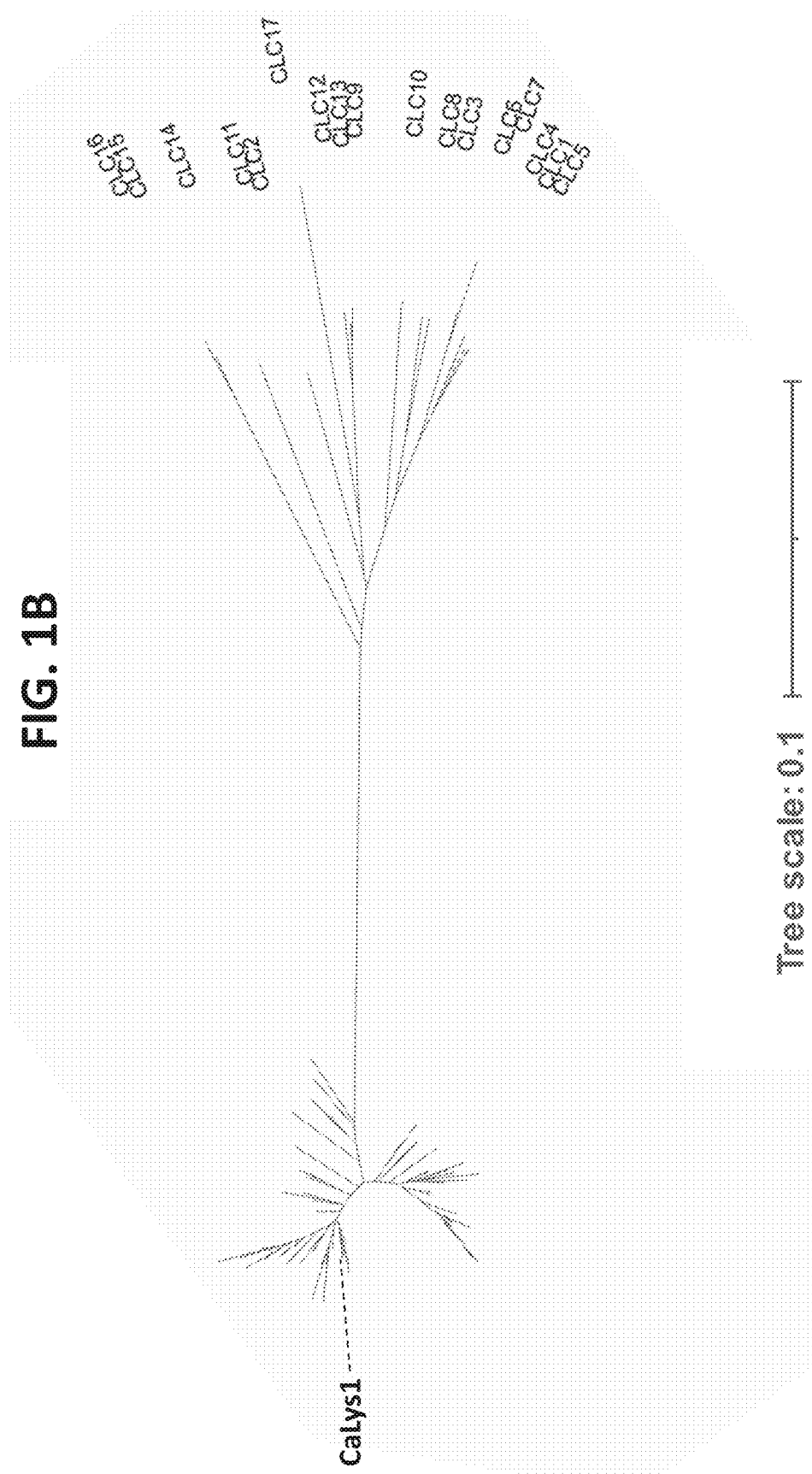
FIG. 1B shows a phylogenetic tree comparing the amidase domains of CLC1-CLC19 with the amidase domains of endolysins found in the genomes of *C. acnes* strains/phages including CaLys1. The amidase domains of the CLC1 family of proteins form a distinct grouping separate from the amidase domains found in the CaLys1 family of endolysins. The CLC18 amidase domain is identical to the CLC1 amidase domain, and the CLC19 amidase domain is identical to CLC13 amidase domain, such that these domains are not shown separately in FIG. 1B.
Figure 27:
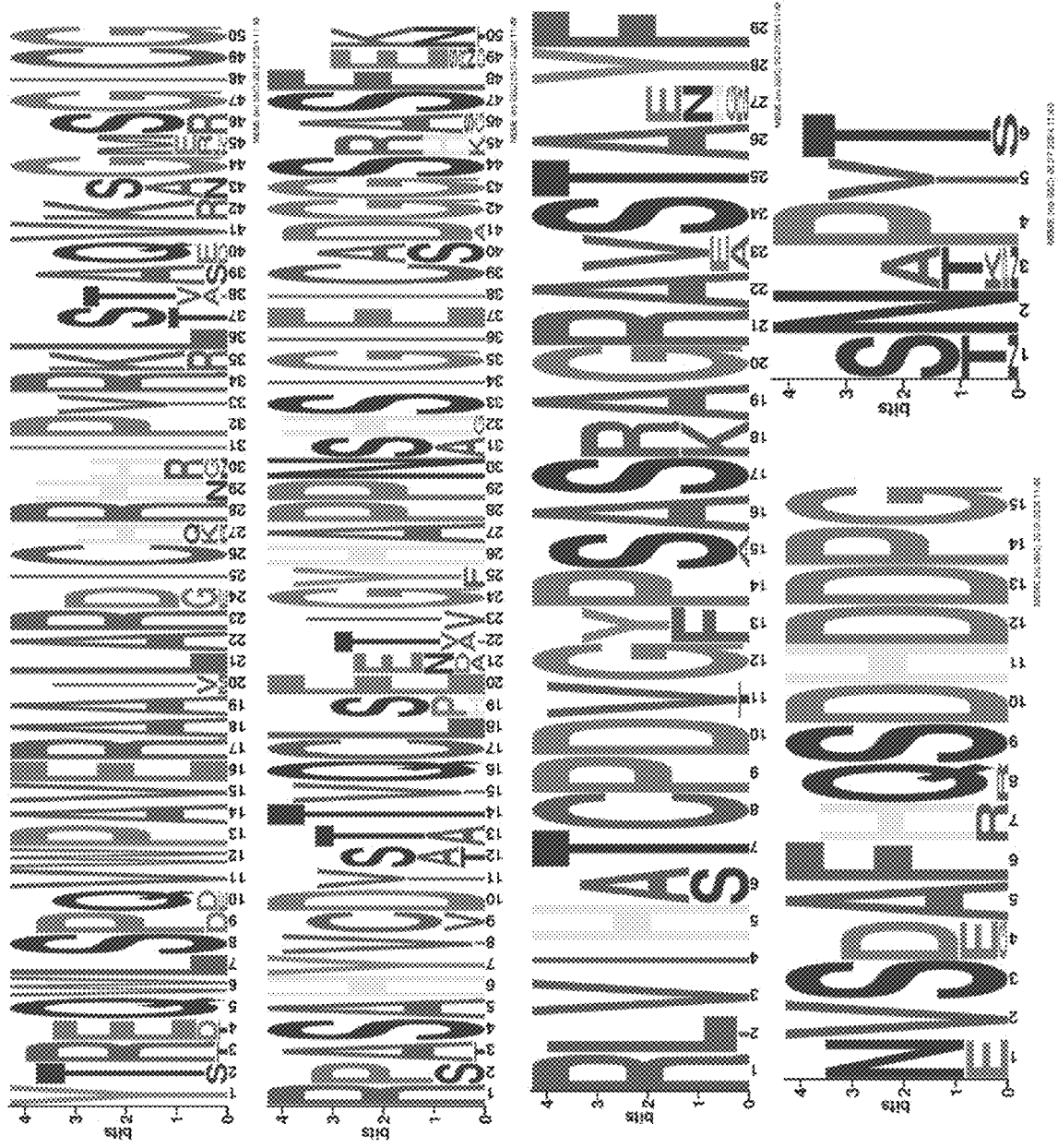
FIG. 27 shows a motif analysis of the CLC1-family EADs.

These genomes were bioinformatically analyzed for proteins that contain an N-acetylmuramoyl-L-alanine amidase domain (Pfam: Amidase_2) which is commonly found in endolysins across a broad range of bacteria, including the CaLys1 family. This search identified a novel family of amidases found in a number of *Cutibacterium* sp. including *C. avidum, C. granulosum*, and *C. porci*, including 19 proteins we have designated CLC1-CLC19 (all of which are referred to as the "CLC1 family" of amidases in this application). Amino acid sequences for full length CLC1-CLC19 are contained in SEQ ID NO: 1-19, respectively. These amidases show similarity to the CaLys1 endolysin family (~70% amino acid identity), but form a distinct phylogenetic grouping separate from the CaLys1 family found in *C. acnes* phages/prophages (FIG. 1A). Table 9 lists the GenBank ID numbers of the non-CLC1 family branches of the phylogenetic tree depicted in FIG. 1A. Phylogenetic comparison of just the amidase EADs of these proteins (SEQ ID NO: 20-36) also confirmed that the amidase EADs of the CLC1 family are distinct from the amidase EADs of the CaLys1 family (FIG. 1B). Table 10 lists the GenBank ID numbers, and amino acid region of the EADs, of the non-CLC family branches of the phylogenetic tree depicted in FIG. 1B. Using multiple sequence alignment tools (Clustal Omega and EMBOSS Cons, see Madeira et al., *Nucleic Acids Research* 2024 July; 52(W1): W521-W525), it was also determined that the CLC1-family EADs shared a significant core of conserved residues (SEQ ID NO: 2939). FIG. 27 provides the results of a further motif analysis identifying conserved motifs among the CLC1-family EADs.

TABLE 9

Non-CLC1-family branches of phylogenetic tree in FIG. 1A.

| Branch #* | GenBank ID No | Branch # | GenBank ID No | Branch # | GenBank ID No |
|---|---|---|---|---|---|
| 1 | WIW76974.1 | 28 | YP 009160118.2 | 55 | YP 009160253.2 |
| 2 | YP 008531700.1 | 29 | YP 009147244.1 | 56 | DAS49433.1 |
| 3 | AGI12425.1 | 30 | QHB37111.1 | 57 | ATN91960.1 |
| 4 | YP 009148336.1 | 31 | YP 009149934.1 | 58 | REB26552.1 |
| 5 | YP 008531655.1 | 32 | YP 008531564.1 | 59 | YP 008531926.1 |
| 6 | YP 009160074.1 | 33 | QPB11563.1 | 60 | YP 006907017.1 |
| 7 | YP 009146913.1 | 34 | YP 009214894.1 | 61 | YP 009152681.1 |
| 8 | YP 008531836.1 | 35 | DAW17174.1 | 62 | YP 009148291.1 |
| 9 | YP 009288342.1 | 36 | AUV62559.1 | 63 | WJJ53926.1 |
| 10 | YP 008531610.1 | 37 | YP 001285596.1 | 64 | QHB36558.1 |
| 11 | DAT38689.1 | 38 | DAQ10842.1 | 65 | DAP54624.1 |
| 12 | YP 009152381.1 | 39 | AUV62178.1 | 66 | DAQ38945.1 |
| 13 | YP 009152726.1 | 40 | YP 006906466.1 | 67 | YP 009191365.1 |
| 14 | CaLys1 | 41 | AUX13513.1 | 68 | ACG76347.1 |
| 15 | YP 006906916.1 | 42 | QHB37534.1 | 69 | ACG76345.1 |
| 16 | YP 009153269.1 | 43 | ATN90299.1 | 70 | YP 009159847.1 |
| 17 | YP 009145789.1 | 44 | YP 006906607.1 | 71 | YP 009277894.2 |
| 18 | YP 004414725.1 | 45 | EAD6310143.1 | 72 | YP 008531745.1 |
| 19 | DAO96639.1 | 46 | YP 008531791.1 | 73 | QPB11813.1 |
| 20 | YP 006906560.1 | 47 | YP 006906421.1 | 74 | ATN89071.1 |
| 21 | YP 009160208.2 | 48 | QFP94545.1 | 75 | DAR77727.1 |
| 22 | YP 009160163.1 | 49 | DAO94404.1 | 76 | YP 006906513.1 |
| 23 | YP 009152610.1 | 50 | QHB36809.1 | 77 | PZR03097.1 |
| 24 | YP 009277998.1 | 51 | YP 009145834.1 | 78 | AUV62306.1 |
| 25 | USN17903.1 | 52 | YP 009160298.1 | 79 | YP 009159893.1 |
| 26 | UZV39505.1 | 53 | YP 009152426.1 | 80 | YP 009151449.1 |
| 27 | YP 006906792.1 | 54 | YP 009603689.1 | 81 | YP 009160027.1 |

* Branch # is listed in clockwise order enumerated from the branch immediately clockwise from CLC1.

TABLE 10

Non-CLC1-family branches of phylogenetic tree in FIG. 1B.

| Branch #* | GenBank ID No. | EAD AA region | Branch # | GenBank ID No. | EAD AA region |
|---|---|---|---|---|---|
| 1 | YP_008531745.1 | 14-174 | 56 | YP_008531926.1 | 13-173 |
| 2 | DAT38689.1 | 13-173 | 57 | YP_009159893.1 | 13-173 |
| 3 | QFP94545.1 | 13-173 | 58 | DAR27346.1 | 13-173 |
| 4 | YP_008531882.1 | 13-173 | 59 | ATN90299.1 | 13-173 |
| 5 | DAX59447.1 | 14-174 | 60 | YP_009151220.1 | 14-174 |
| 6 | YP_009152610.1 | 13-173 | 61 | QPB11563.1 | 13-173 |
| 7 | YP_009151449.1 | 13-173 | 62 | QPB11659.1 | 13-173 |
| 8 | AUV62306.1 | 13-173 | 63 | DAQ38945.1 | 13-173 |
| 9 | PZR03097.1 | 13-173 | 64 | ATN90343.1 | 13-173 |
| 10 | YP_009277894.2 | 13-173 | 65 | AUV62178.1 | 14-174 |
| 11 | YP_009152681.1 | 13-173 | 66 | ATN90914.1 | 13-173 |
| 12 | YP_008531700.1 | 14-174 | 67 | CaLys1 | 13-173 |
| 13 | QPB11813.1 | 13-173 | 68 | YP_006906607.1 | 13-173 |
| 14 | YP_006906046.1 | 25-185 | 69 | DAJ24593.1 | 14-174 |
| 15 | YP_009603689.1 | 13-173 | 70 | USN17903.1 | 14-174 |
| 16 | YP_006906513.1 | 13-173 | 71 | EAD6310143.1 | 13-173 |
| 17 | DAR77727.1 | 13-173 | 72 | QHB37534.1 | 13-173 |
| 18 | ATN89071.1 | 13-173 | 73 | YP_006906421.1 | 13-173 |
| 19 | QHB36809.1 | 13-173 | 74 | YP_008531791.1 | 13-173 |
| 20 | YP_009151398.1 | 25-185 | 75 | AGI12651.1 | 14-174 |
| 21 | YP_009151538.1 | 14-174 | 76 | YP_009153269.1 | 14-174 |
| 22 | DAS49433.1 | 13-173 | 77 | QHB36558.1 | 13-173 |
| 23 | ATN91960.1 | 13-173 | 78 | AUX13513.1 | 13-173 |
| 24 | YP_009292055.1 | 13-173 | 79 | YP_009145789.1 | 18-178 |
| 25 | YP_006907017.1 | 13-173 | 80 | YP_001285596.1 | 14-174 |
| 26 | REB26552.1 | 13-173 | 81 | AUV62559.1 | 14-174 |
| 27 | YP_009160253.2 | 13-173 | 82 | ACG76345.1 | 13-173 |

TABLE 10-continued

Non-CLC1-family branches of phylogenetic tree in FIG. 1B.

| Branch # * | GenBank ID No. | EAD AA region | Branch # | GenBank ID No. | EAD AA region |
|---|---|---|---|---|---|
| 28 | YP_008531745.1 | 14-174 | 83 | ACG76347.1 | 13-173 |
| 29 | DAT38689.1 | 13-173 | 84 | DAQ10842.1 | 14-174 |
| 30 | QFP94545.1 | 13-173 | 85 | YP_009191365.1 | 13-173 |
| 31 | YP_008531882.1 | 13-173 | 86 | ASJ79920.1 | 14-174 |
| 32 | DAX59447.1 | 14-174 | 87 | DAW17174.1 | 14-174 |
| 33 | YP_009152610.1 | 13-173 | 88 | YP_009148291.1 | 13-173 |
| 34 | YP_009151449.1 | 13-173 | 89 | YP_009160027.1 | 13-173 |
| 35 | AUV62306.1 | 13-173 | 90 | YP_009150263.1 | 13-173 |
| 36 | PZR03097.1 | 13-173 | 91 | AII29464.1 | 14-174 |
| 37 | YP_009277894.2 | 13-173 | 92 | YP_008531564.1 | 14-174 |
| 38 | YP_009152681.1 | 13-173 | 93 | DAP54624.1 | 14-174 |
| 39 | YP_008531700.1 | 14-174 | 94 | YP_009149934.1 | 14-174 |
| 40 | QPB11813.1 | 13-173 | 95 | QHB37111.1 | 14-174 |
| 41 | YP_006906046.1 | 25-185 | 96 | YP_004414725.1 | 14-174 |
| 42 | YP_009603689.1 | 13-173 | 97 | YP_006906560.1 | 13-173 |
| 43 | YP_006906513.1 | 13-173 | 98 | YP_009160118.2 | 13-173 |
| 44 | DAR77727.1 | 13-173 | 99 | YP_009152726.1 | 14-174 |
| 45 | ATN89071.1 | 13-173 | 100 | YP_009152381.1 | 14-174 |
| 46 | QHB36809.1 | 13-173 | 101 | YP_008531610.1 | 25-185 |
| 47 | YP_009151398.1 | 25-185 | 102 | YP_009160208.2 | 13-173 |
| 48 | YP_009151538.1 | 14-174 | 103 | YP_009160074.1 | 13-173 |
| 49 | DAS49433.1 | 13-173 | 104 | YP_009160298.1 | 13-173 |
| 50 | ATN91960.1 | 13-173 | 105 | DAO94404.1 | 13-173 |
| 51 | YP_009292055.1 | 13-173 | 106 | WIW76974.1 | 14-174 |
| 52 | YP_006907017.1 | 13-173 | 107 | YP_009152426.1 | 18-178 |
| 53 | REB26552.1 | 13-173 | 108 | YP_009148336.1 | 18-178 |
| 54 | YP_009160253.2 | 13-173 | 109 | YP_008531655.1 | 13-173 |
| 55 | YP_009159847.1 | 13-173 | | | |

* Branch # is listed in clockwise order enumerated from the branch immediately clockwise from CLC5.

Figure 2:
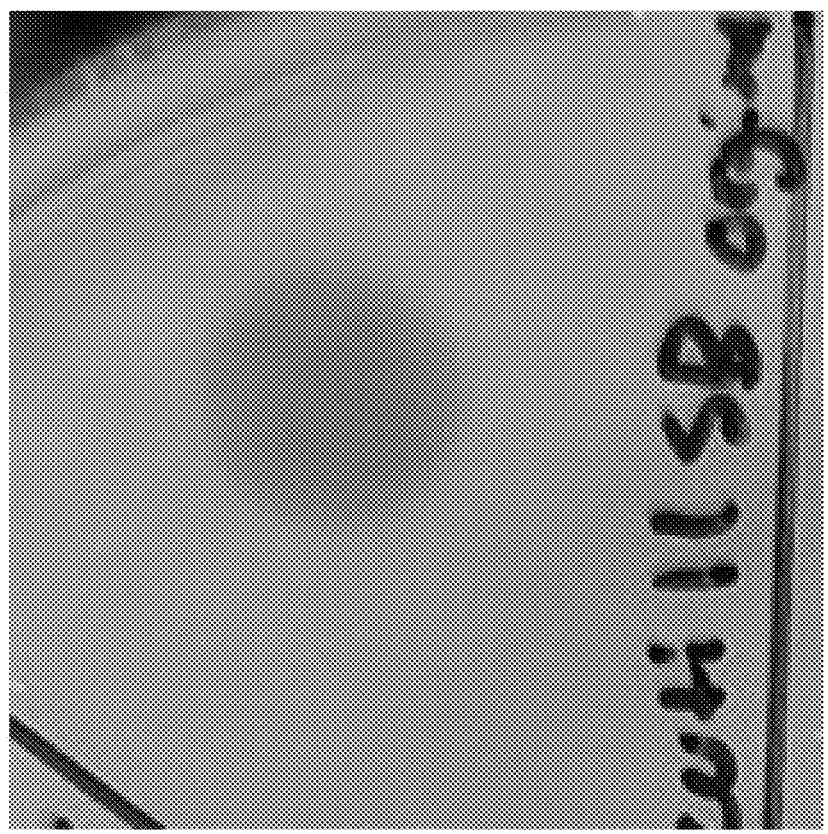
FIG. 2 is an image showing that the cell lysate from BL21 cells expressing CLC1 generated a zone clearing on plates embedded with *C. acnes*.

Example 2: CLC1 Protein Displays High Solubility and Significant Anti-*C. acnes* Lytic Activity To test if the CLC1 family of putative endolysins has lytic activity against *C. acnes*, CLC1 was cloned into an inducible expression plasmid and the protein was expressed in BL21 *E. coli* cells. A 6×His tag was added to the protein during these cloning steps. Cell lysate was then tested for activity in a clearing assay. Briefly, *C. acnes* cells were embedded in soft agar to create an opaque plate. Candidate enzymes (either purified or from *E. coli* lysate) can be spotted on these plates which results in a clearing/halo if the enzyme has anti-*C. acnes* activity. When lysate from BL21 *E. coli* cells expressing CLC1 was spotted in this halo assay, a clearing/halo was observed, indicating anti-*C. acnes* activity (FIG. 2).

Importantly, the observed anti-*C. acnes* activity with CLC1 did not require any extra steps to resolubilize the protein. In contrast, lysate from BL21 cells expressing CaLys1 did not result in any clearing in this halo assay, consistent with previous reports that CaLys1 protein is predominantly insoluble (and thus inactive) when expressed in *E. coli* without further manipulation.

Figure 3:
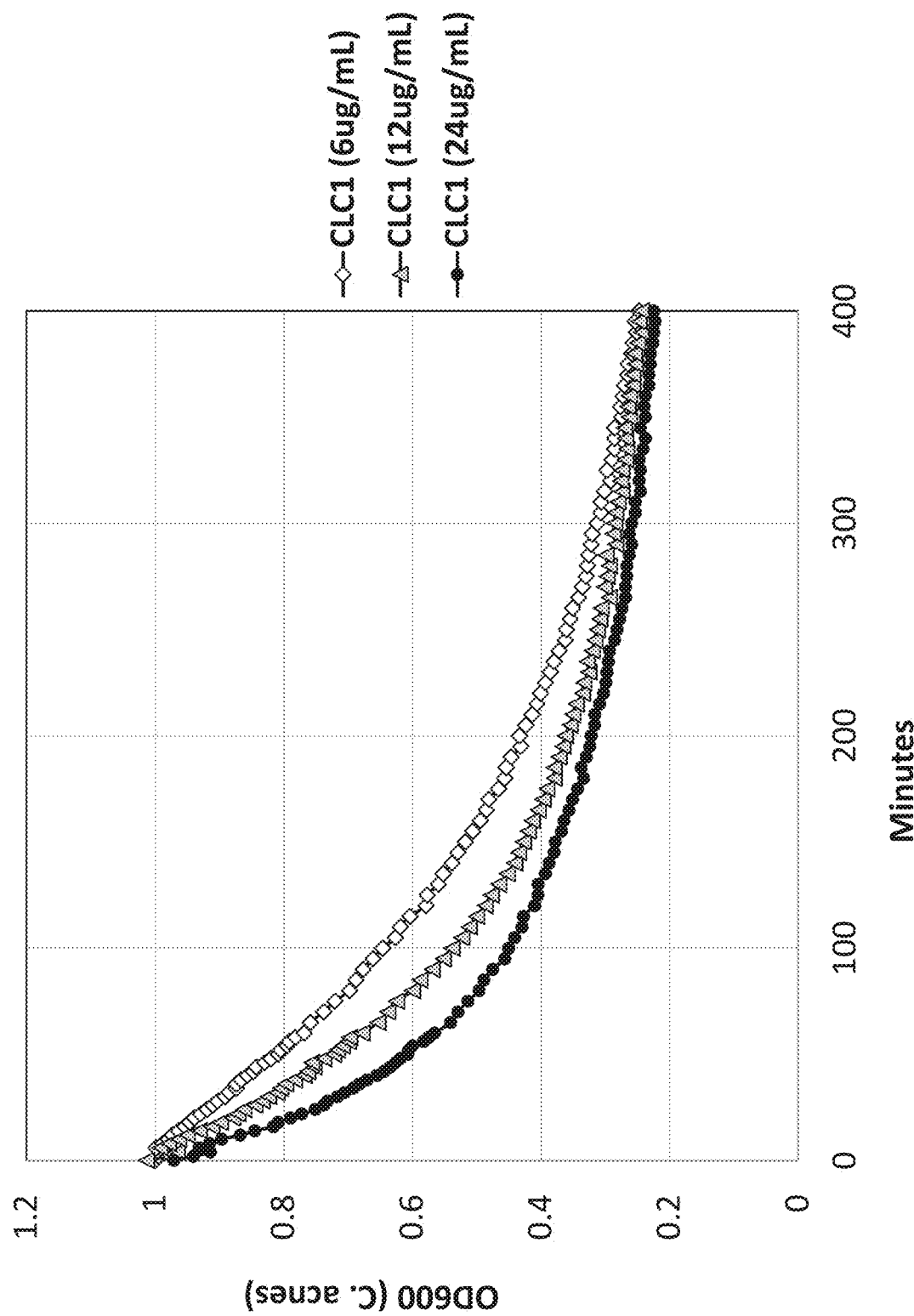
FIG. 3 is a chart showing the results of a turbidity reduction assay demonstrating that purified CLC1 displays lytic activity against *C. acnes*.

To further characterize the activity of CLC1, CLC1 was purified from cell lysate using the 6×His tag and then tested in a turbidity reduction assay. In this assay, *C. acnes* cells were resuspended at an $OD_{600}$ of ~1.0 and then treated with purified enzyme. If the enzyme has *C. acnes* lytic activity, the $OD_{600}$ decreases over time. The results confirmed that CLC1 had anti-*C. acnes* activity (FIG. 3). Notably, CLC1 had activity at a concentration range (6 µg/mL-24 µg/mL) which is lower than that reported for CaLys1 (100 µg/mL). Further, CLC1 protein remained soluble after purification using the 6×His tag. Thus, CLC1 represents a novel endolysin that is soluble expressed from *E. coli* and has lytic activity against *C. acnes*.

Example 3: CLC1-Truncation Exhibits Improved Solubility and Lytic Activity Compared to Full Length Protein Bioinformatically-predicted protein domains in the CLC1-family of enzymes were identified using SMART and CD-Search. Using these tools, the inventors discovered that the vast majority of CLC1-family members have an N-terminal amidase domain (the EAD) followed by a C-terminal region of approximately 100 amino acids with no predicted protein domains. The exception is CLC15, which is longer and is predicted to have repeat domains of unknown function.

Figure 4:
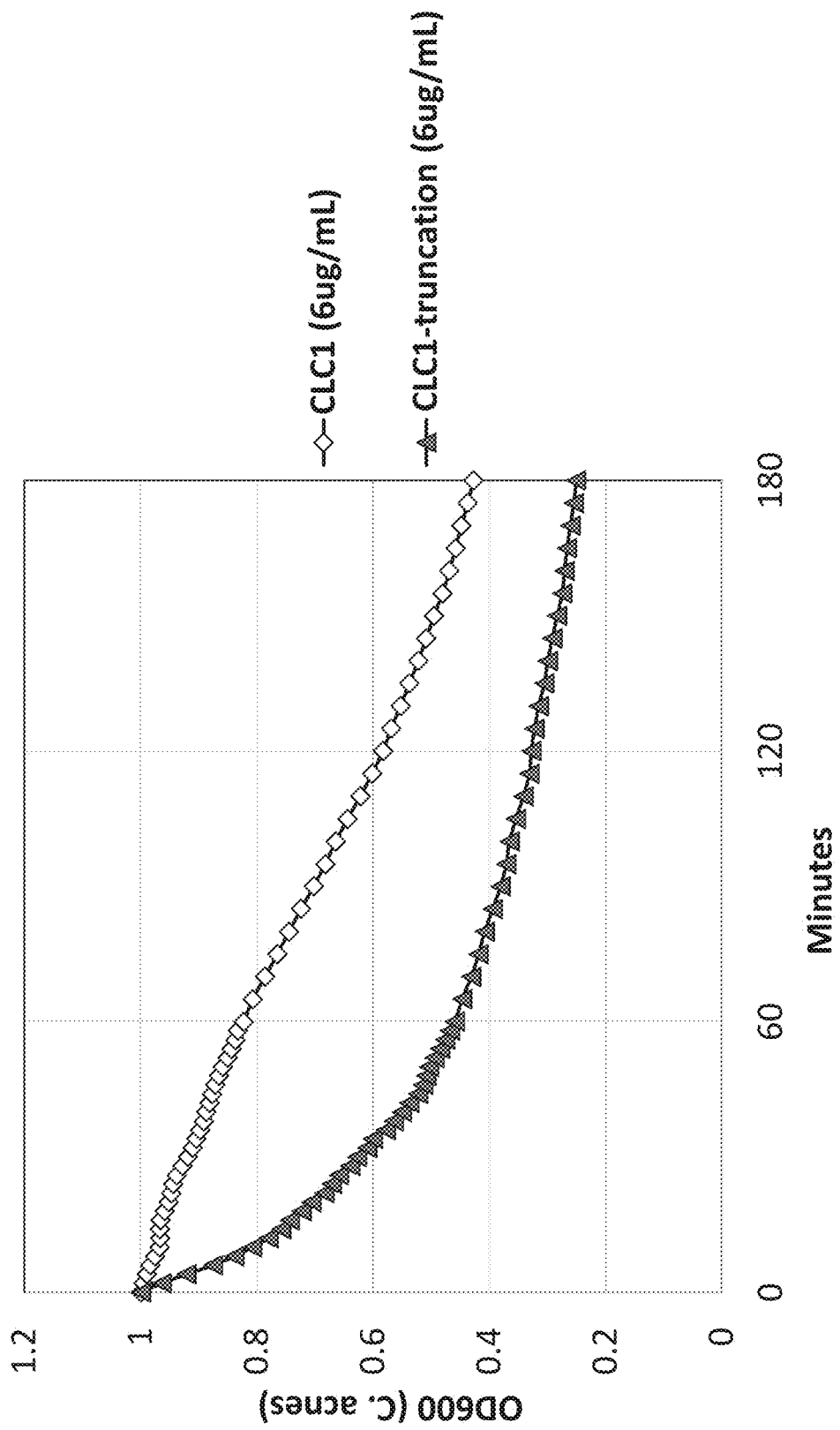
FIG. 4 shows the results of a turbidity reduction assay demonstrating that CLC1-truncation exhibits higher anti-*C. acnes* lytic activity than full-length native CLC1.

Despite the lack of any predicted protein domains, this C-terminal region is conserved across the CLC1-family members and in CaLys1, suggesting that it may have some biological function. To assess the effect of this C-terminal domain on CLC1 activity, the inventors generated a truncated form of CLC1 lacking the C-terminal 85 amino acids ("CLC1-truncation"). The protein was expressed in BL21 *E. coli*, purified, and tested in turbidity reduction assays. Surprisingly, the inventors found that CLC1-truncation had increased solubility as compared to full-length CLC1, as evidenced by significantly higher yields of soluble protein after *E. coli* expression. In addition, the CLC1-truncation was surprisingly found to be significantly more active than full-length CLC1 in a turbidity reduction assay measuring lytic activity against *C. acnes* (FIG. 4). These data indicate that removal of the C-terminal portion of the CLC1 protein has positive effects on both solubility and activity, resulting in a more stable protein with much stronger lytic activity against *C. acnes*.

Figure 5C:
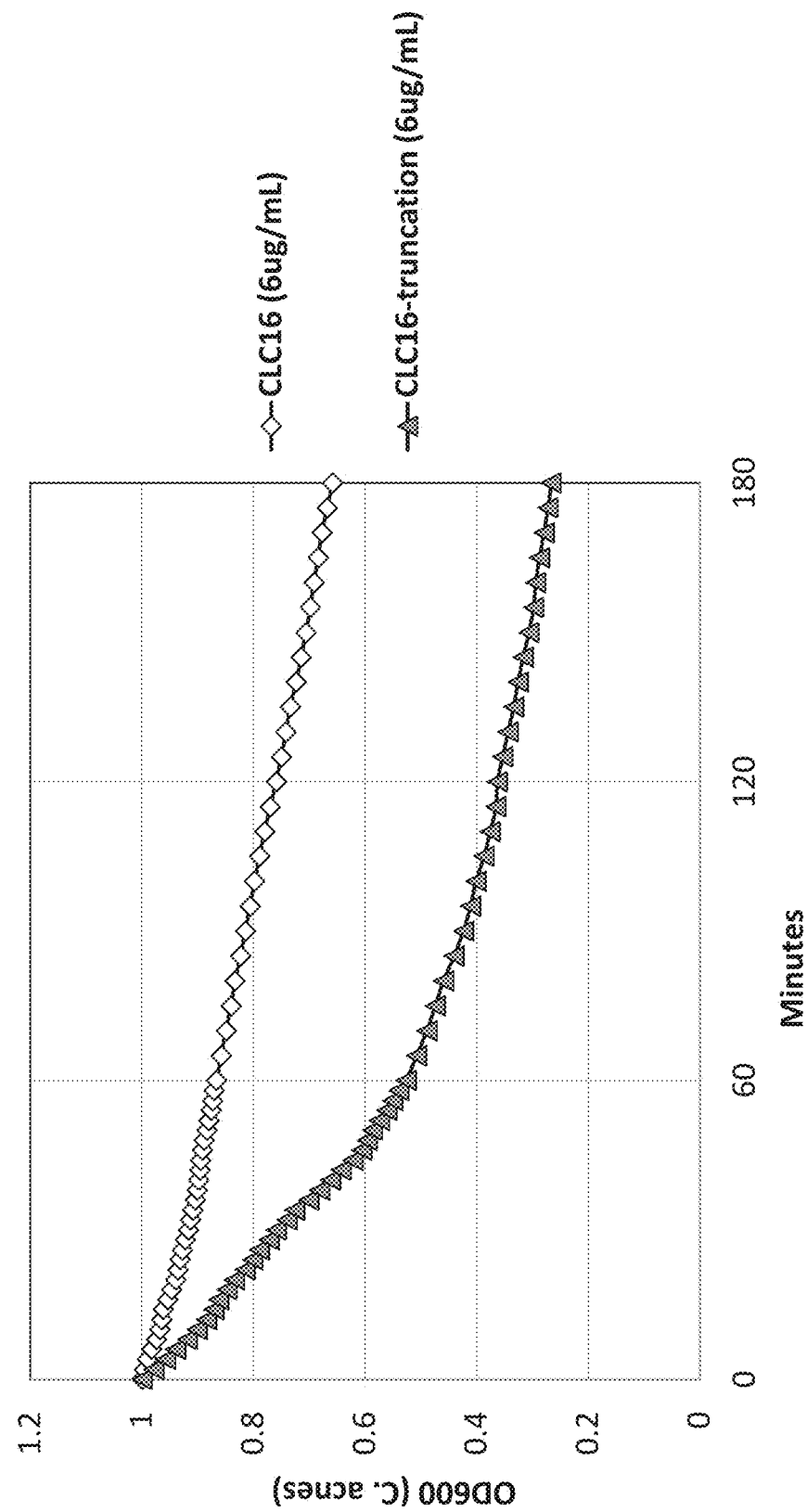
Figure 5D:
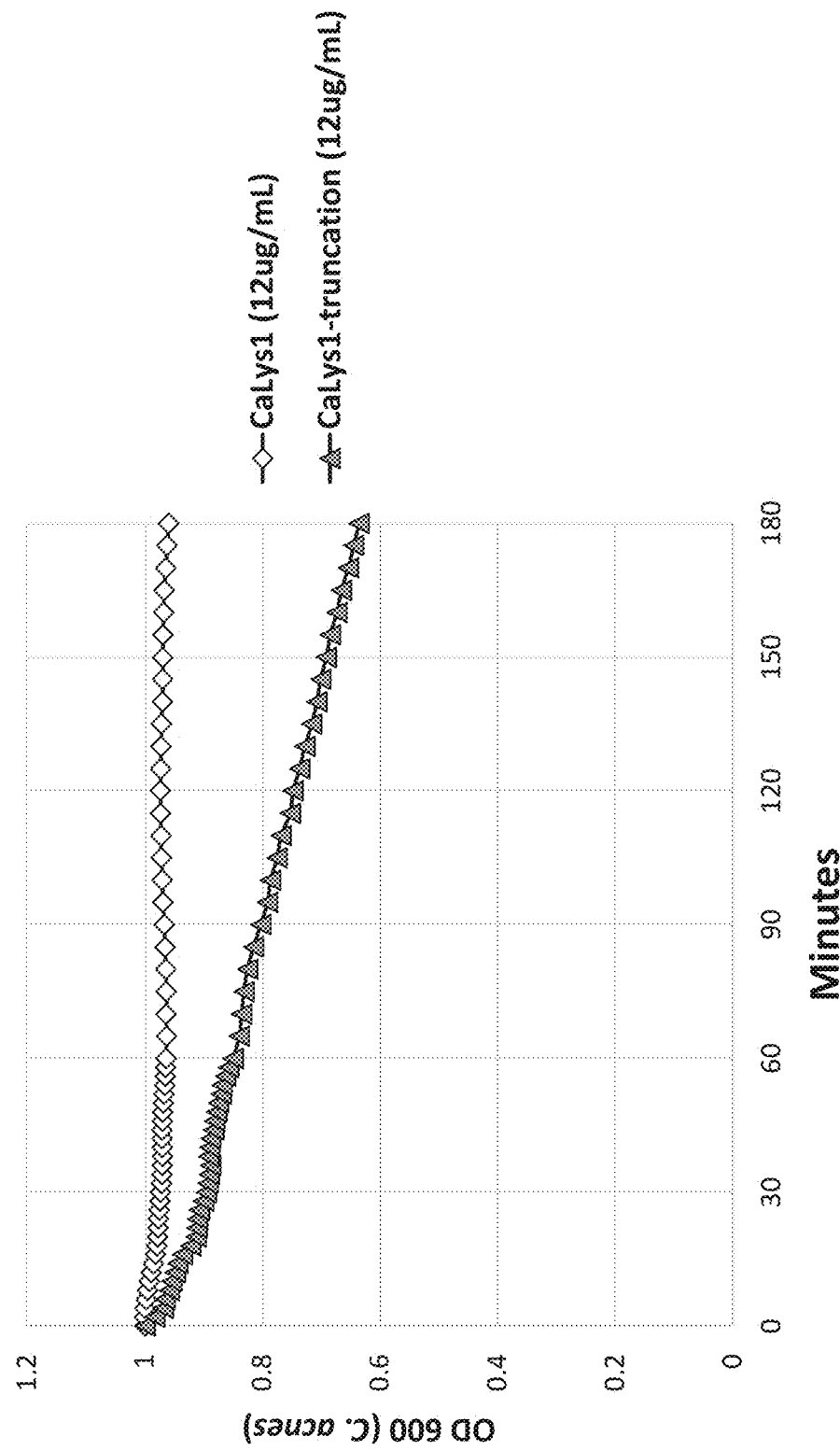

Example 4: Removal of C-Terminal Regions of Other CLC1-Family Proteins and CaLys1 Also Improves Solubility and Activity Full-length CLC2 and CLC3 showed relatively weaker *C. acnes* lytic activity when purified, with poorer soluble protein yields, compared to other CLC proteins. The inventors removed about 85 amino acids from the C-terminal ends of both proteins to generate a CLC2-truncation and a CLC3-truncation, respectively. Full-length CLC2, full-length CLC3, CLC2-truncation, and CLC3-truncation were purified and tested for *C. acnes* lytic activity in a turbidity reduction assay. The truncated proteins demonstrated both higher soluble proteins yields as well as significantly stronger *C. acnes* lytic activity in the turbidity reduction assays (FIG. 5A-5B). C-terminal truncations were also generated for CLC16 and CaLys1 and tested in a turbidity reduction assay against their full-length counterparts. In both cases, the truncation exhibited improved solubility and lytic activity compared to their full-length counterparts (FIG. 5C-5D). These data demonstrate that the removal of the C-terminal region of the CLC1-family of proteins, and of CaLys1, has positive effects on solubility and activity in turbidity reduction assays. The improved solubility and activity of CaLys1-truncation is particularly surprising in view of the known issues with solubility and activity for full-length CaLys1. Table 5 provides the sequences of the CLC1-family truncations, as well as the CaLys1 truncation, all of which are expected to exhibit improved solubility and lytic activity compared to their full-length counterparts, as was observed for CLC1, CLC2, CLC3, CLC16, and CaLys1.

II. Examples 5-7: Novel *C. acnes* Cell Wall Binding Domains

Figure 6:
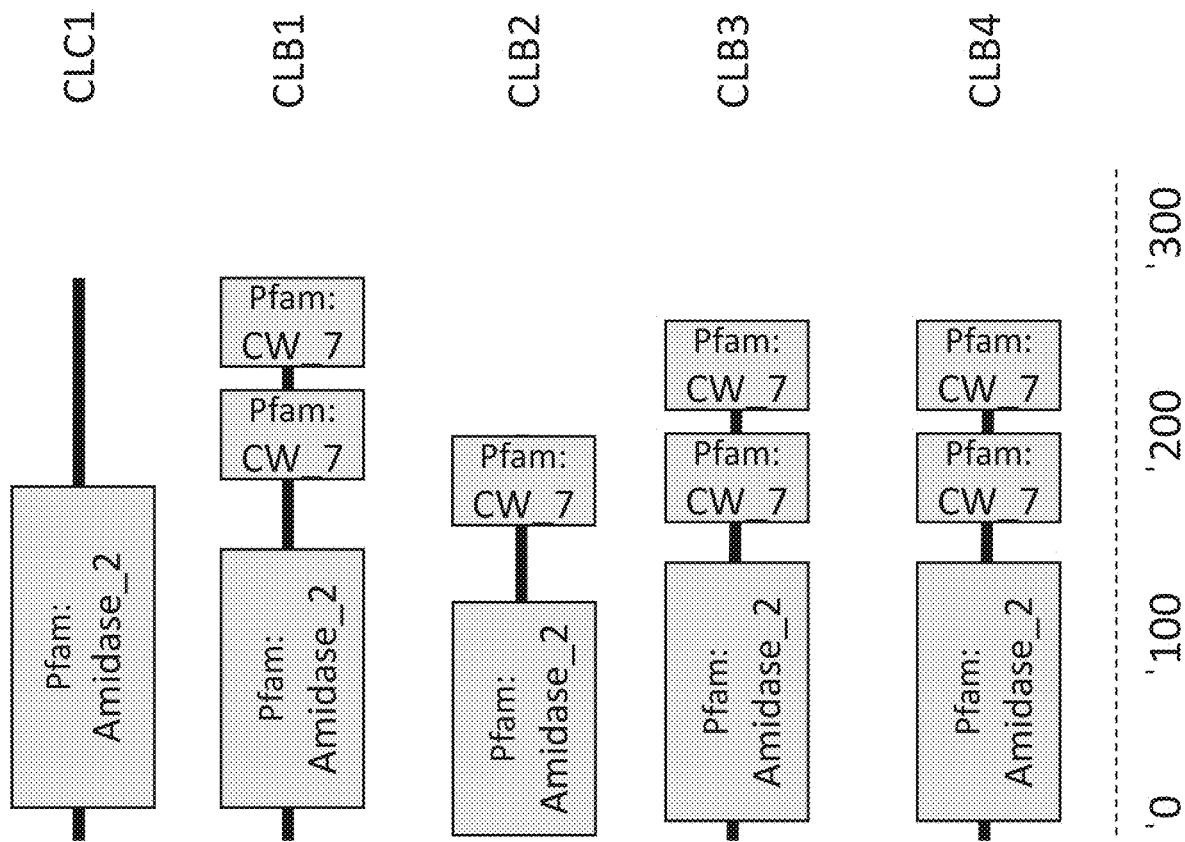
FIG. 6 shows schematics of domain organization of the indicated proteins. CLB1, CLB2, CLB3, and CLB4 containing putative cell wall binding domains composed of 1 or 2 CW_7 domains. In contrast, the C-terminal end of CLC1 does not encode a computationally predicted protein domain.

Example 5: Identification of CLB1-CLB4 as Putative Cell Wall Hydrolases from *Cutibacterium* sp. and *Propionimicrobium* Sp. Containing CW_7 Cell Wall Binding Domains Many endolysins, particularly endolysins that target gram-positive bacteria, contain both an enzymatically active domain (EAD) as well as a cell wall binding domain (CBD). The cell wall binding domain is responsible for recognizing and binding epitopes in the peptidoglycan of target bacteria, thus bringing the EAD to its target substrate. In this way, the CBD can increase specificity and/or activity. No known CBDs have been shown to recognize and bind *C. acnes*. To find a CBD that could recognize *C. acnes*, the genomes of *Cutibacterium* sp. and broader Propionibacteriaceae family bacteria were subjected to bioinformatics analysis for putative cell wall hydrolases that contain possible cell wall binding domains. Four uncharacterized putative proteins (CLB1-CLB4) were identified from *C. avidum* (CLB1), *C. acnes* (CLB2), and *Propionimicrobium lymphophilum* (CLB3 and CLB4). All four proteins contain an N-terminal amidase domain. CLB1, CLB3, and CLB4 have predicted C-terminal cell wall binding domains containing two CW_7 domain repeats, while CLB2 has a predicted C-terminal cell wall binding domain containing a single CW_7 repeat (FIG. 6).

Figure 7A:
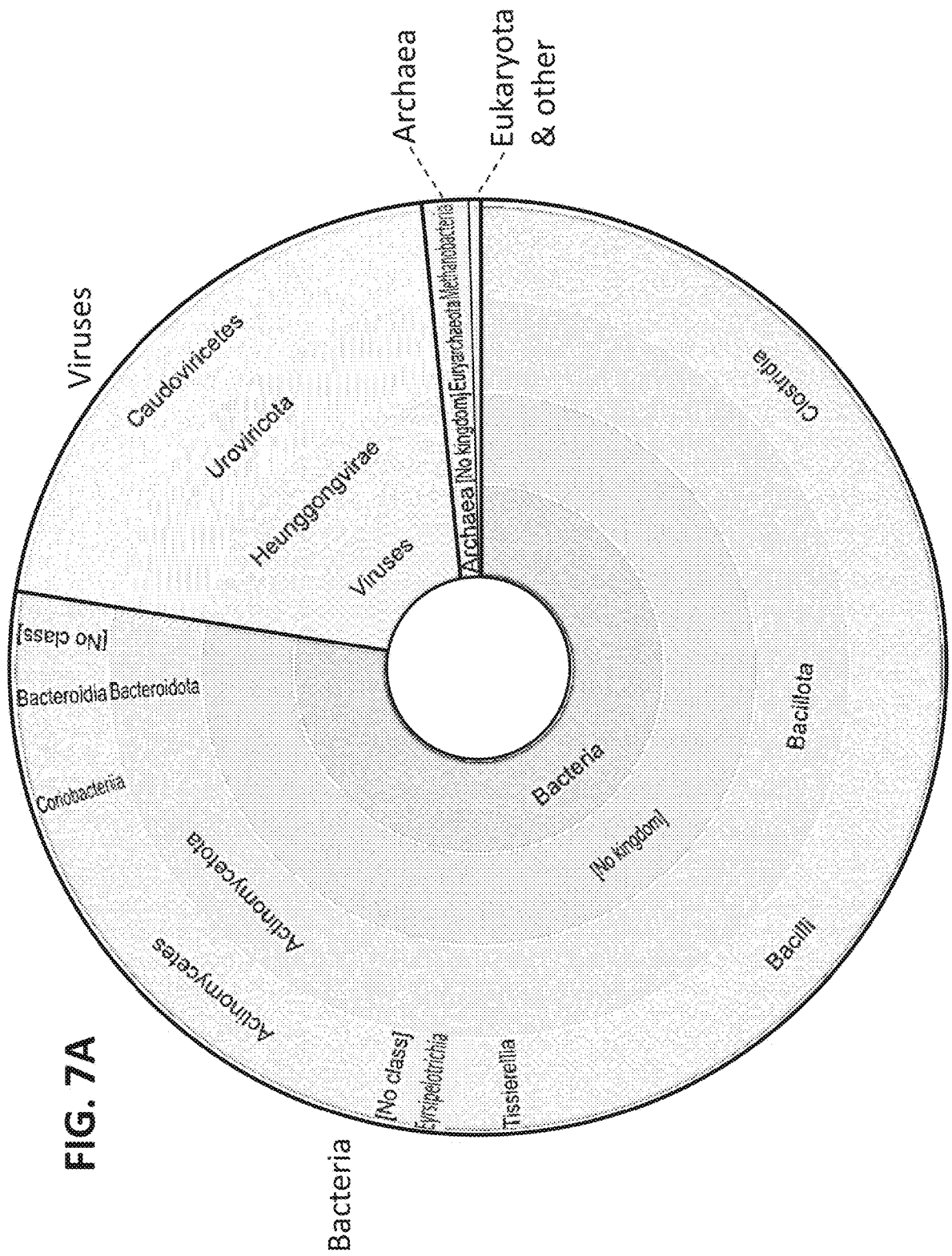
FIG. 7A shows the taxonomic distribution of proteins containing CW_7 repeat domains that were identified in a protein database search performed herein.
Figure 7B:
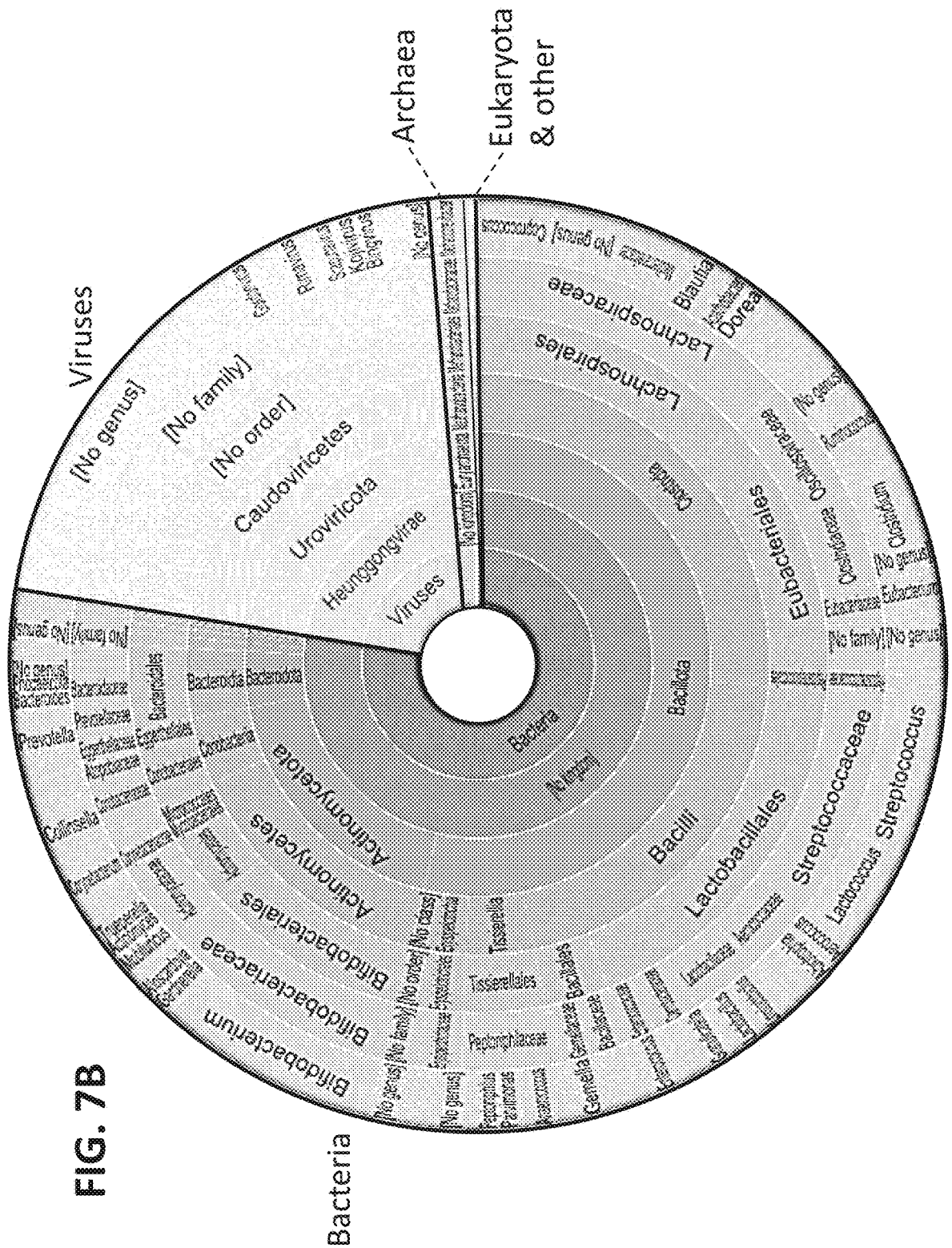
FIG. 7B shows the detailed taxonomic distribution of proteins containing CW_7 repeat domains that were identified in a protein database search performed herein.

Example 6: Identification of Large Family of CBDs with Broad Taxonomical Diversity Comprising CW_7 Repeats The CLB1-4 CBDs contain 1 or 2 CW_7 repeats. CW_7 repeats are fairly small (37-40 aa) and are believed to bind peptidoglycan chains. See Bustamante et al., *Sci Rep* 2017 Nov. 28; 7(1):16494. In order to characterize the taxonomical diversity of CW_7 repeats, the Uniprot database was searched for proteins containing CW_7 domains using the Interpro domain entry IPR013168. Uniprot contains ~1,333 proteins annotated to have 1 or more CW_7 repeats that are found in a broad range of bacterial species, primarily within the Actinobacteria and Firmicutes bacterial phyla as well as associated bacteriophage viruses with a smaller representation in Bacteriodota (FIG. 7A-7B). A BLASTP search was also performed in the non-redundant protein database using the CLB2-CBD CW_7 repeat sequence as a query. Using this search, 2,656 protein sequences were identified with an E-value <0.05. The CW_7 repeat sequences in these proteins range from 43.59% to 100% amino acid identity to the CLB2-CBD CW_7 query and, again, come from a broad diversity of bacterial species and associated viruses. For each protein, the GenBank Accession Number, SEQ ID NO, and percent identity of the top CW_7 match are listed in Table 7. Sequences for the CW_7 CBD comprising proteins identified in this search are provided in SEQ ID NO: 282-2938.

Example 7: CLB1-CBD and CLB2-CBD can Target Chimeric Cell Wall Hydrolases Against *C. acnes*

Figure 8B:
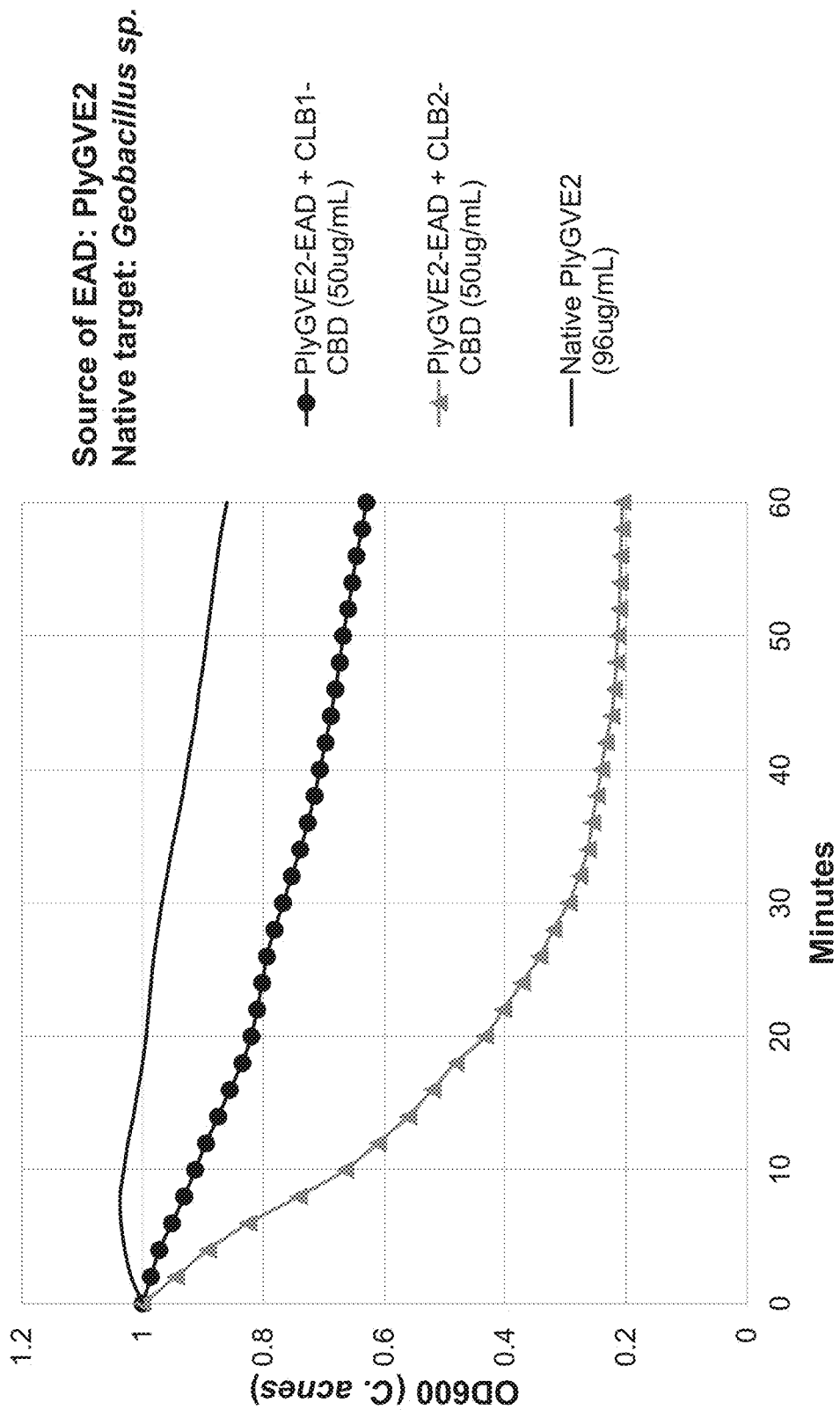

To prove that the newly identified CBDs bind to *C. acnes*, the inventors explored the possibility of using the CLB1 and CLB2 CBDs to create chimeric proteins with activity against *C. acnes*. To test this idea, two endolysins that natively target other genera of bacteria and not *C. acnes* were selected: CD27L, which typically targets *Clostridium difficle* (Mayer et al., J Bacteriol. 2008 October; 190(20):6734-40); and PlyGVE2, which comes from a thermophilic phage shown to infect *Geobacillus* sp. (Jin et al., Microbiology (Reading). 2013 August; 159(Pt 8):1597-1605). The EADs from these two endolysins were fused to either CLB1-CBD or CLB2-CBD. The resultant chimeric proteins were expressed, purified and their activity was tested against *C. acnes* in a turbidity reduction assay. The native CD27L and PlyGVE2 proteins were also expressed, purified, and tested. While the native CD27L and PlyGVE2 did not exhibit any lytic activity against *C. acnes*, the four chimeric CWHs were able to lyse *C. acnes*, a bacterium which is well outside the native target genera of the two source endolysins, demonstrating that CLB1-CBD and CLB2-CBD can be used to create chimeric cell wall hydrolases that target *C. acnes* by fusing EADs to these CBDs (FIG. 8A-8B).

III. Examples 8-19: Novel CLC1-Family EAD and CW_7 CBD Chimeras

Example 8: Chimeras Comprising CLC1-3 EADs in Combination with CLB1-4 CBDs Exhibit Anti-*C. acnes* Activity The CLC1 family of amidases is composed of an N-terminal amidase with conserved sequences at the C-terminal end. However, while conserved, there is no predicted protein domain encoded by this sequence and thus no clear CBD (FIG. 4). Thus, without wishing to be bound by any particular theory, it was hypothesized by the inventors that the activity of the CLC1 family of amidases could be modified by fusing the EADs of the CLC1 family to CBDs that can recognize and bind *C. acnes*.

A set of 8 chimeric proteins composed of combinations of the EADs from CLC1, CLC2, and CLC3 and the CBDs from CLB1, CLB2, CLB3, and CLB4 were generated to test if the CBDs of CLB1-CLB4 could target *C. acnes*. The design of these proteins is provided in Table 11 below.

TABLE 11

Design of Chimeric Proteins

| CHIMERIC PROTEINS CREATED | | Enzymatic Domains (EADs) | | |
|---|---|---|---|---|
| | | CLC1-EAD | CLC2-EAD | CLC3-EAD |
| Cell Wall Binding Domains (CBDs) | CLB1-CBD | CLC1-EAD + CLB1-CBD | CLC2-EAD + CLB1-CBD | CLC3-EAD + CLB1-CBD |
| | CLB2-CBD | CLC1-EAD + CLB2-CBD | CLC2-EAD + CLB2-CBD | CLC3-EAD + CLB2-CBD |
| | CLB3-CBD | CLC1-EAD + CLB3-CBD | | |
| | CLB4-CBD | CLC1-EAD + CLB4-CBD | | |

Figure 9A:
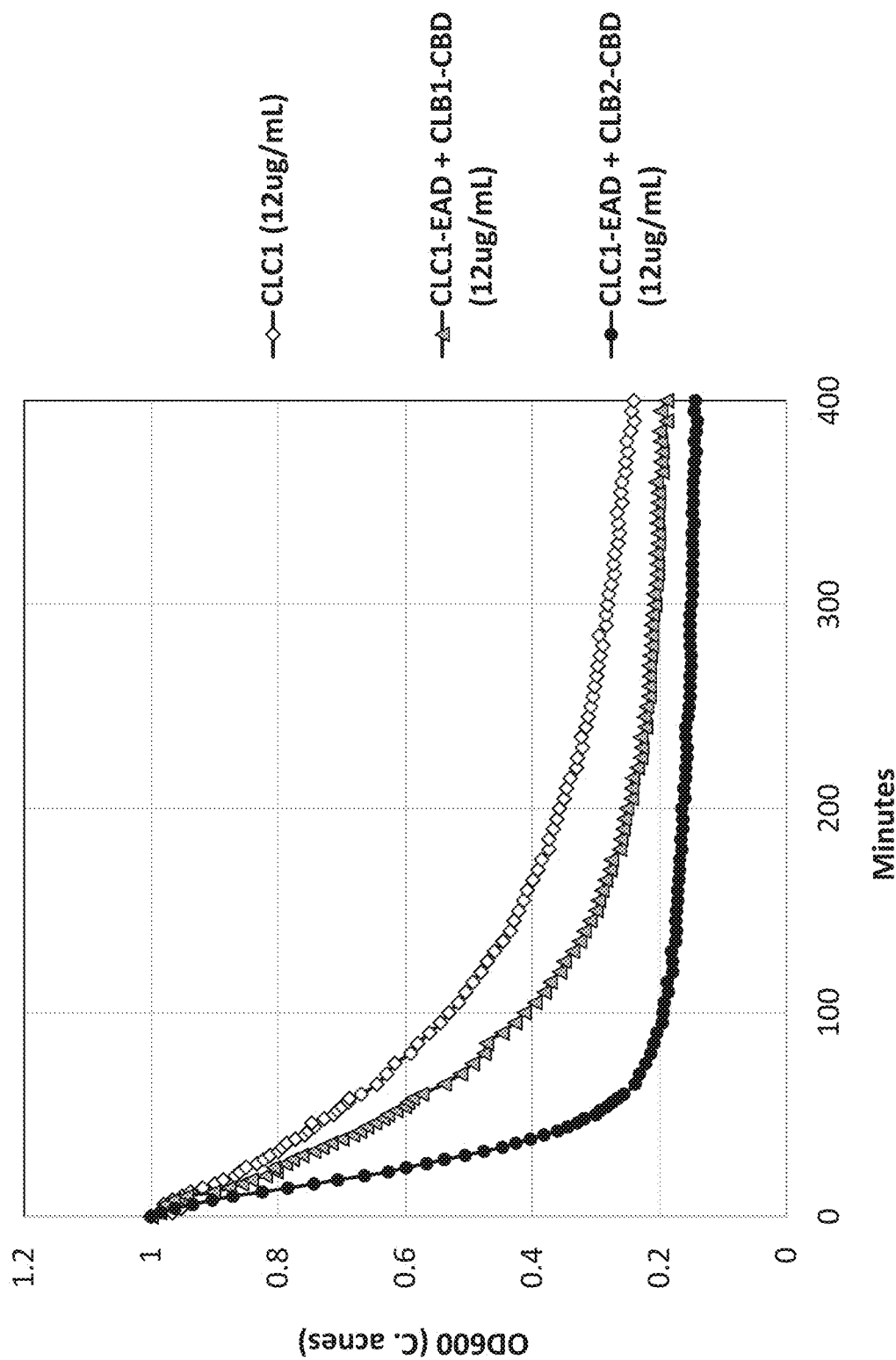
FIG. 9A is a chart of turbidity reduction assay results showing that chimeric proteins linking the CLC1 EAD with the CLB1 CBD and the CLB2 CBD displayed significantly increased *C. acnes* lytic activity compared to the native CLC1 protein.
Figure 9B:
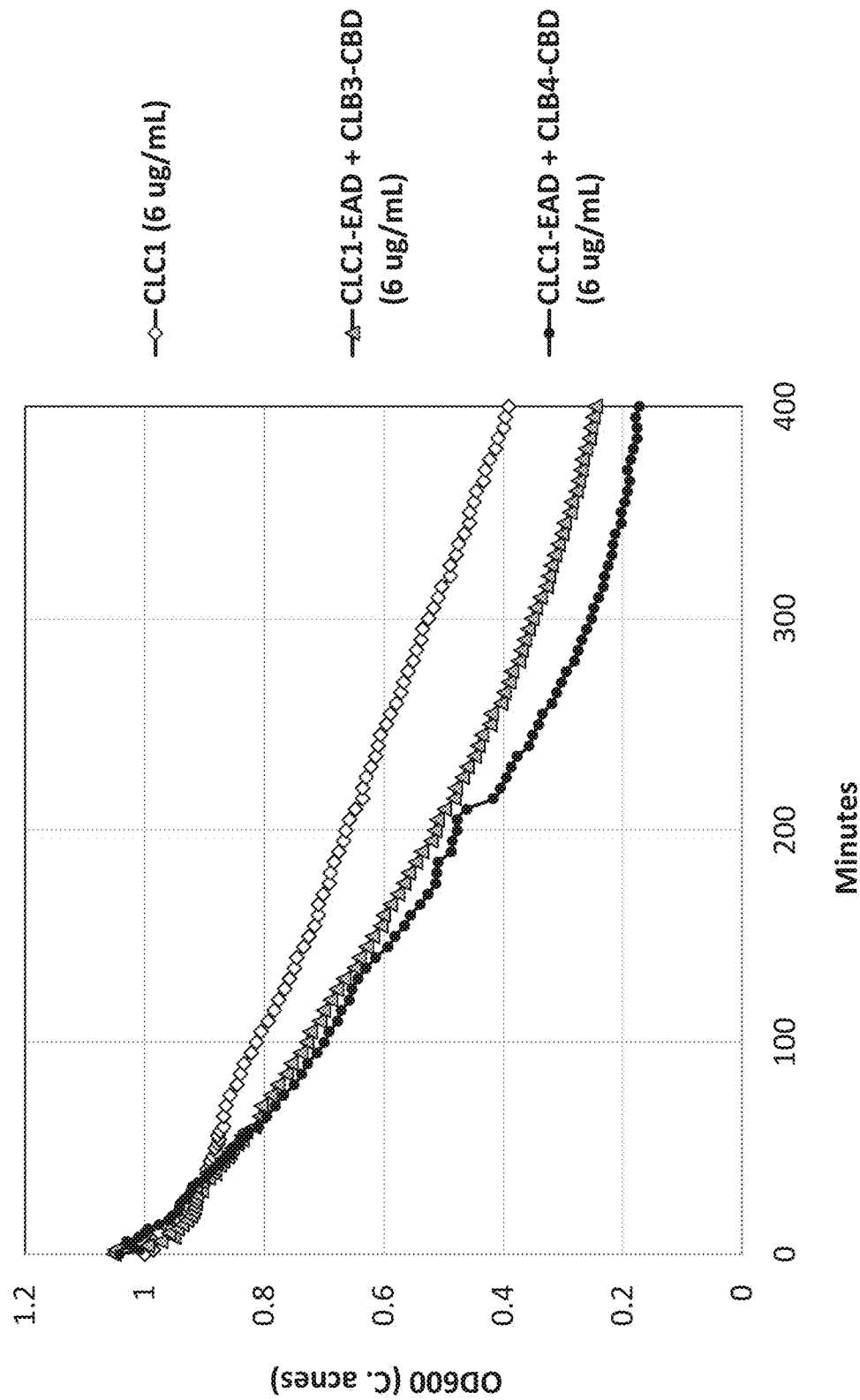
FIG. 9B is a chart of turbidity reduction assay results showing that chimeric proteins linking the CLC1 EAD with the CLB3 CBD and the CLB4 CBD displayed significantly increased *C. acnes* lytic activity compared to the native CLC1 protein.
Figure 9C:
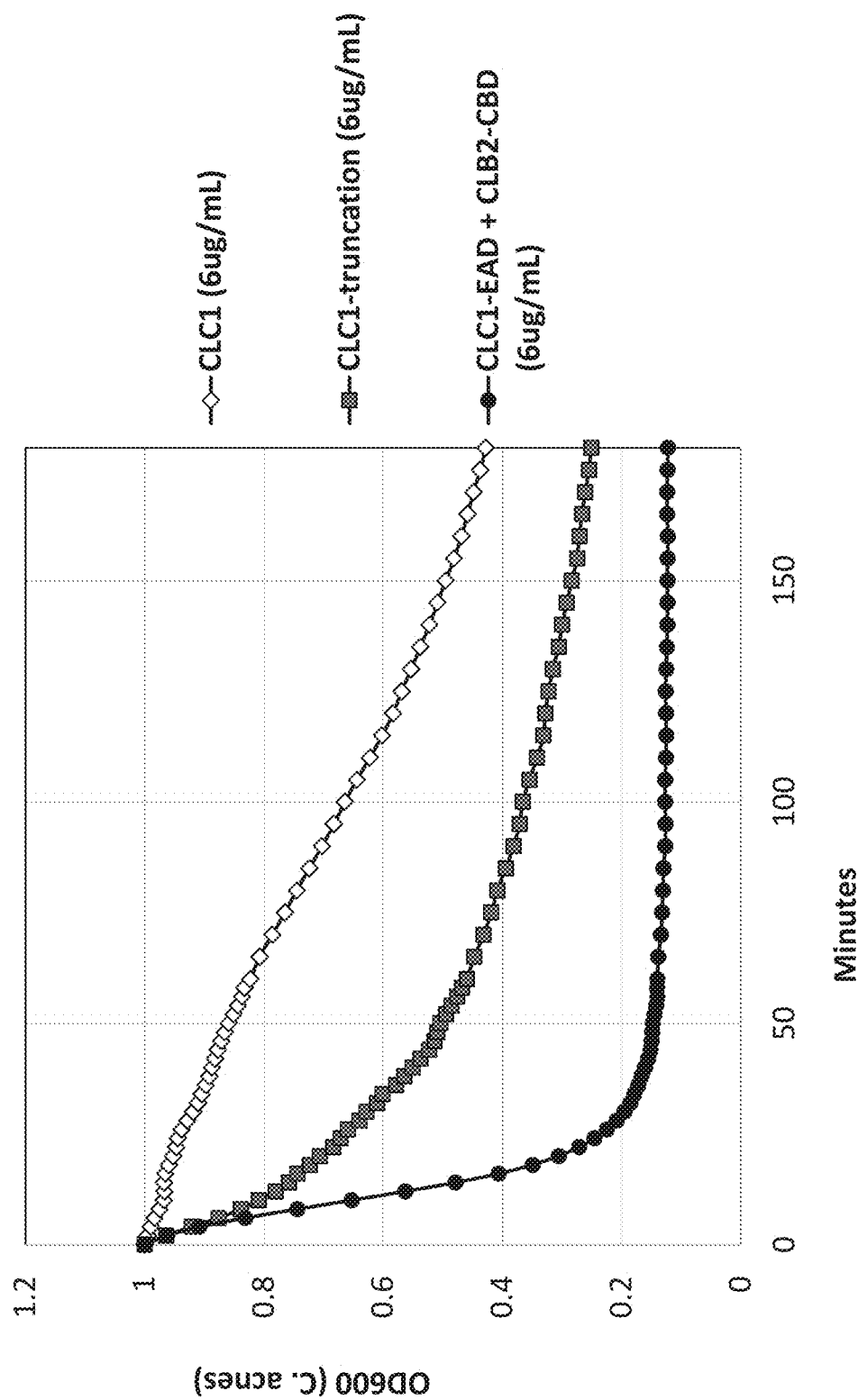
FIG. 9C is a chart of turbidity reduction assay results showing that the CLC1 EAD+CLB2 CBD chimera displayed significantly increased *C. acnes* lytic activity compared to the native CLC1 protein and the CLC1-truncation.

These 8 chimeric proteins were expressed, purified and tested in a turbidity reduction assay. As shown in FIG. 9A and FIG. 9B, native CLC1 protein was compared with chimeric proteins where the CLC1 EAD was linked to the different candidate CBDs (CLC1-EAD+CLB1-CBD, CLC1-EAD+CLB2-CBD, CLC1-EAD+CLB3-CBD, and CLC1-EAD+CLB4-CBD). The results show that all four chimeric proteins demonstrated higher *C. acnes* lytic activity in a turbidity reduction assay compared to the native, full-length CLC1 protein. These data indicate that chimeric cell wall hydrolases comprising the EAD of CLC1 in combination with the CBDs of CLB1-CLB4 can bind and recognize *C. acnes* and exhibit increased activity against *C. acnes* compared to native CLC1. In a further turbidity reduction assay, it was also demonstrated that the CLC1-EAD+CLB2-CBD chimera outperformed both full length CLC1 and the higher activity CLC1-truncation in terms of anti-*C. acnes* lytic activity (FIG. 9C).

Figure 10A:
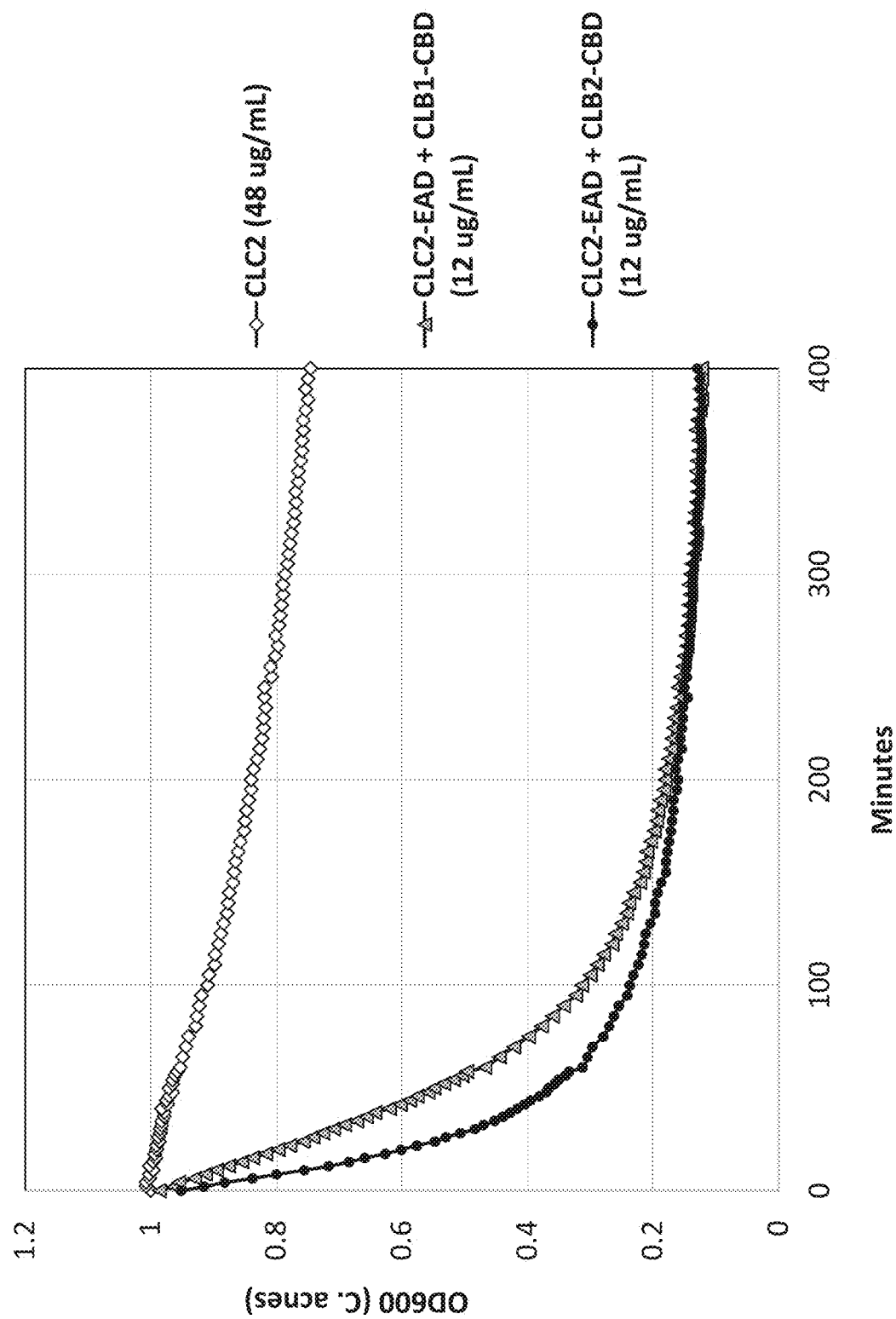
FIG. 10A is a chart of turbidity reduction assay results showing that chimeric proteins linking the CLC2 EAD with the CLB1 CBD and the CLB2 CBD displayed significantly increased *C. acnes* lytic activity compared to the native CLC2 protein.
Figure 10B:
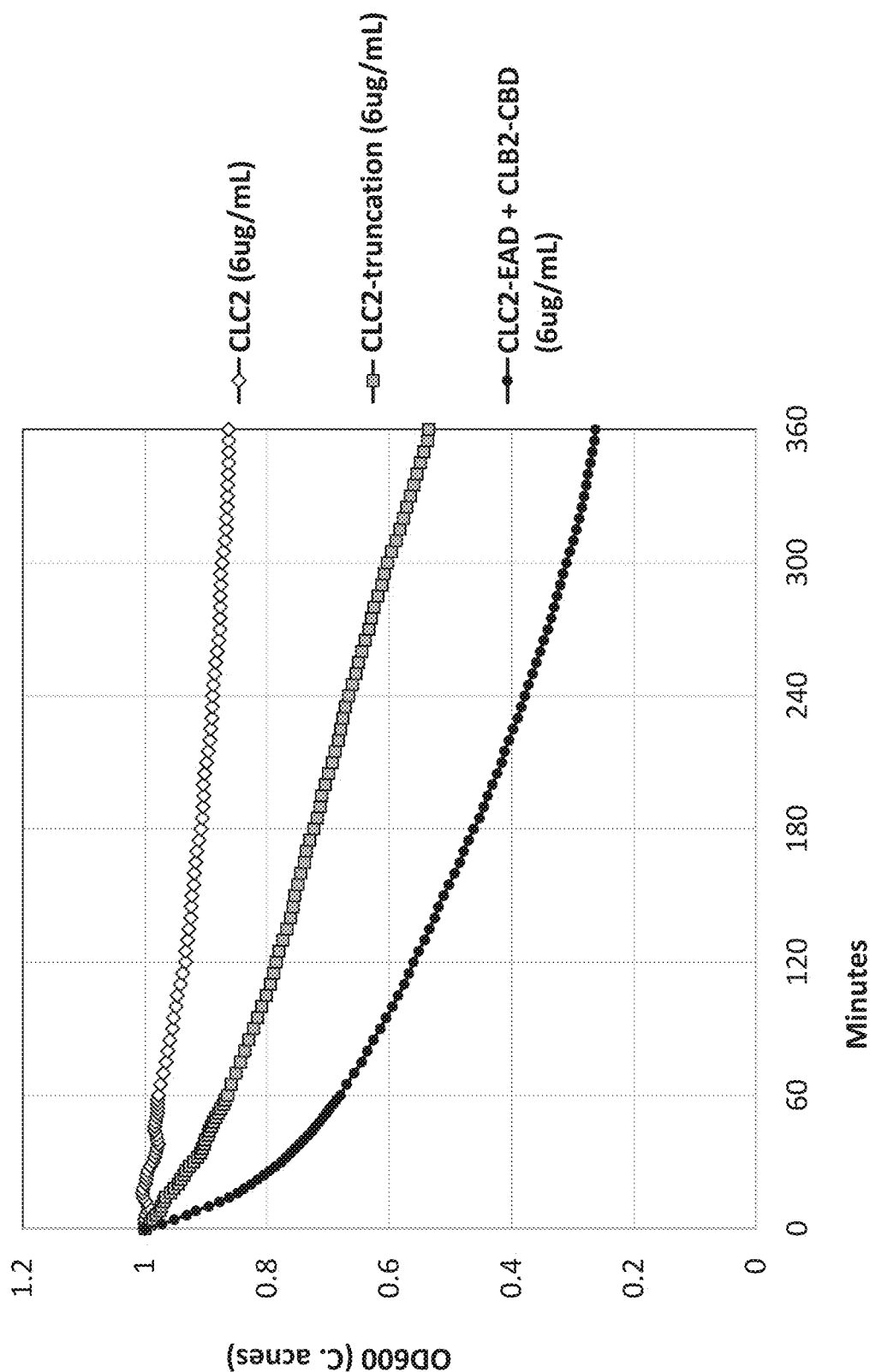
FIG. 10B is a chart of turbidity reduction assay results showing that the CLC2 EAD+CLB2 CBD chimera displayed significantly increased *C. acnes* lytic activity compared to the native CLC2 protein and the CLC2-truncation.
Figure 11A:
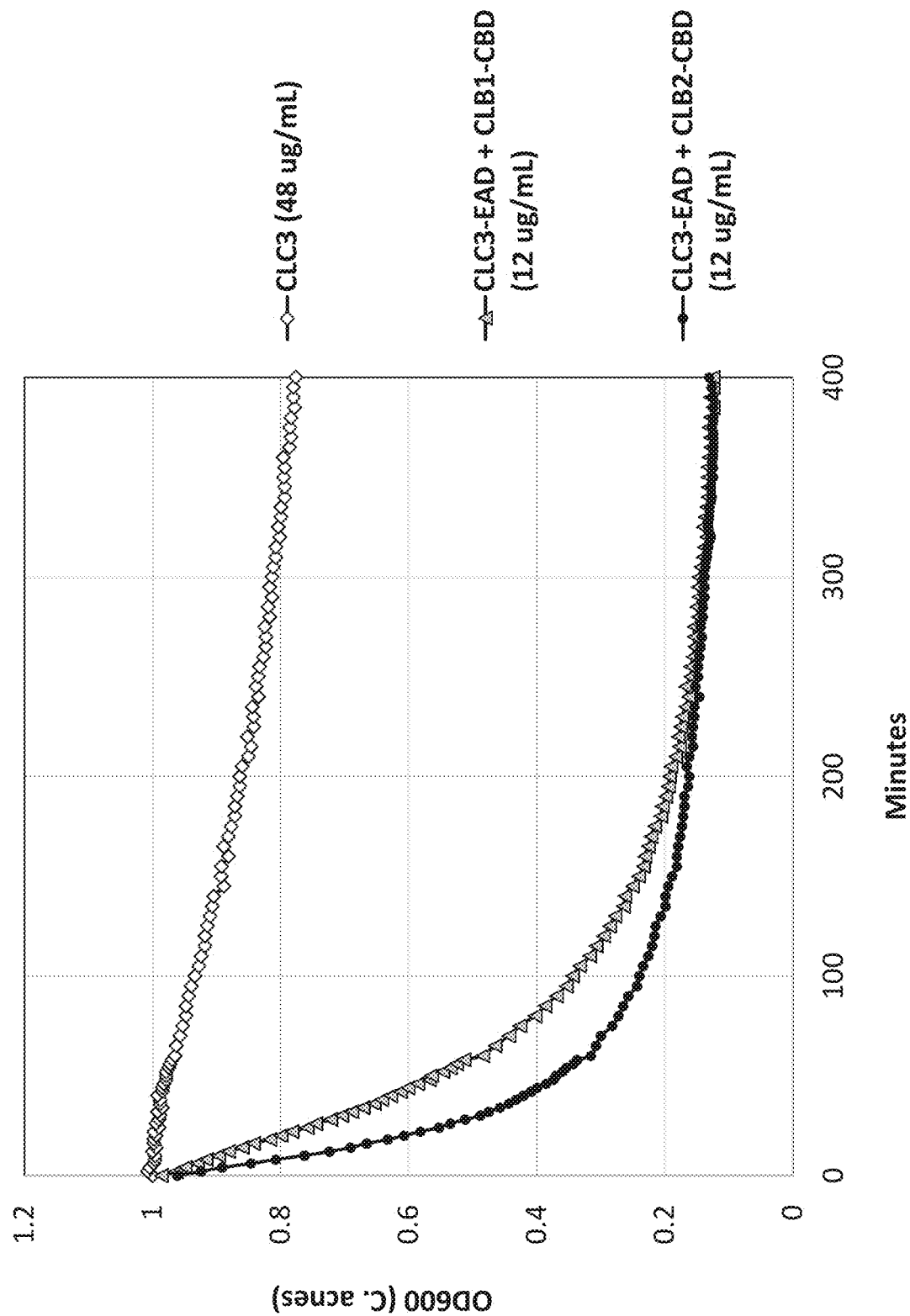
FIG. 11A is a chart of turbidity reduction assay results showing that chimeric proteins linking the CLC3 EAD with the CLB1 CBD and the CLB2 CBD displayed significantly increased *C. acnes* lytic activity compared to the native CLC3 protein.
Figure 11B:
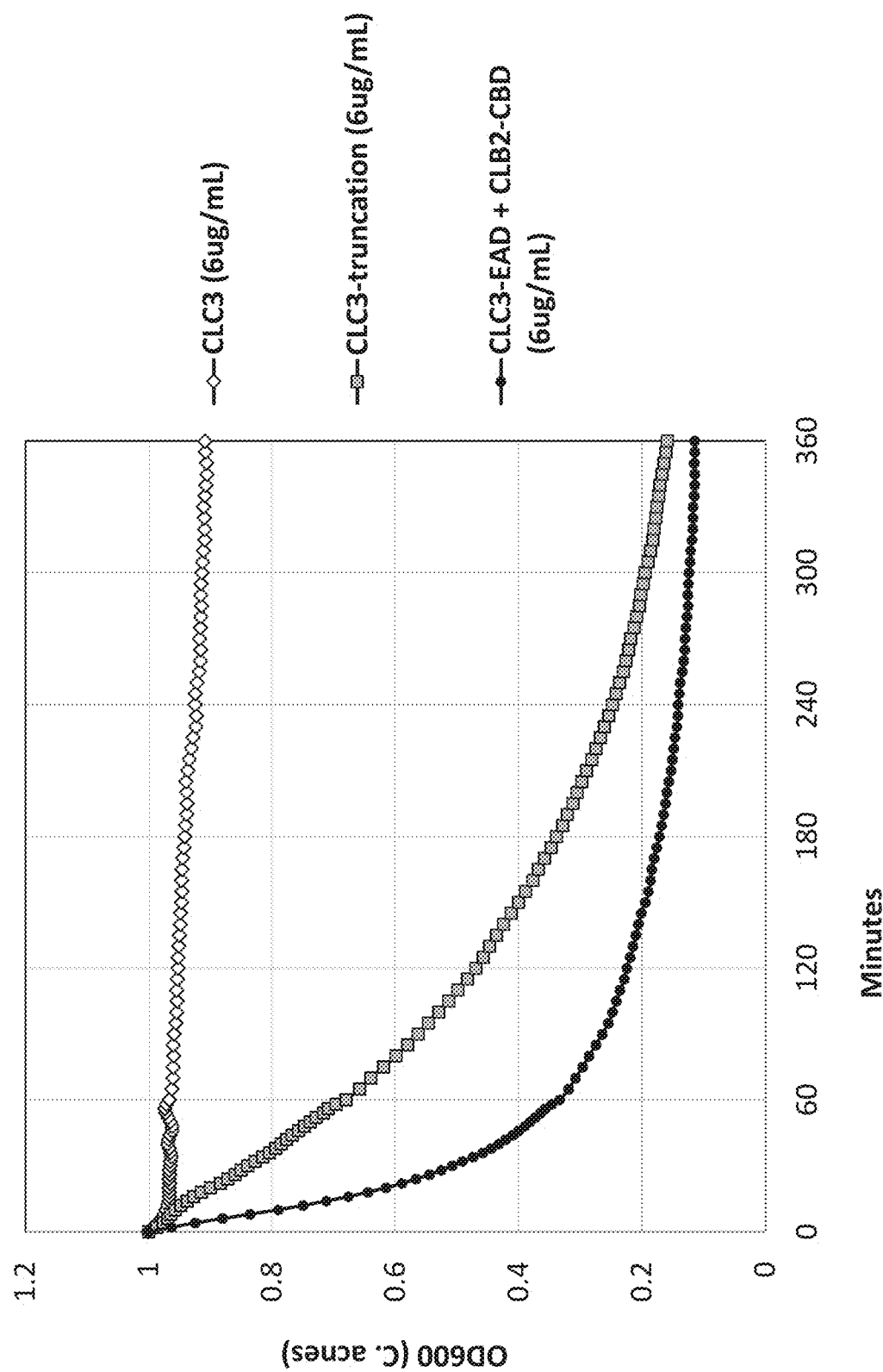
FIG. 11B is a chart of turbidity reduction assay results showing that the CLC3 EAD+CLB2 CBD chimera displayed significantly increased *C. acnes* lytic activity compared to the native CLC3 protein and the CLC3-truncation.

FIG. 10A and FIG. 11A show the results of lytic assays comparing the CLC2 and CLC3 native proteins with the CLC2-EAD chimeras (CLC2-EAD+CLB1-CBD and CLC2-EAD+CLB2-CBD) and CLC3-EAD chimeras (CLC3-EAD+CLB1-CBD and CLC3-EAD+CLB2-CBD). Full-length CLC2 and CLC3 both displayed relatively low *C. acnes* lytic activity. Linking either the CLB1 CBD or the CLB2 CBD to the CLC2 or CLC3 EAD resulted in a dramatic increase in lytic activity compared to native CLC2 or CLC3, similar to the results observed for CLC1. In a further turbidity reduction assay, it was also demonstrated that the CLC2-EAD+CLB2-CBD chimera outperformed both full length CLC2 and the higher activity CLC2-truncation (FIG. 10B). The CLC3-EAD+CLB2-CBD chimera similarly exhibited improved lytic activity compared to both full length CLC3 and the higher activity CLC3-truncation (FIG. 11B).

Example 9: Chimeric Proteins Comprising CLC1-Family EADs and CW_7 CBDs Display Lytic Activity Across a Broad Range of pH Values The enzymatic properties of two CLC1 EAD chimeric proteins (CLC1-EAD+CLB1-CBD and CLC1-EAD+CLB2-CBD) and two CLC3 EAD chimeric proteins (CLC3-EAD+CLB1-CBD and CLC3-EAD+CLB2-CBD) were further characterized at different pH levels.

Figure 12:
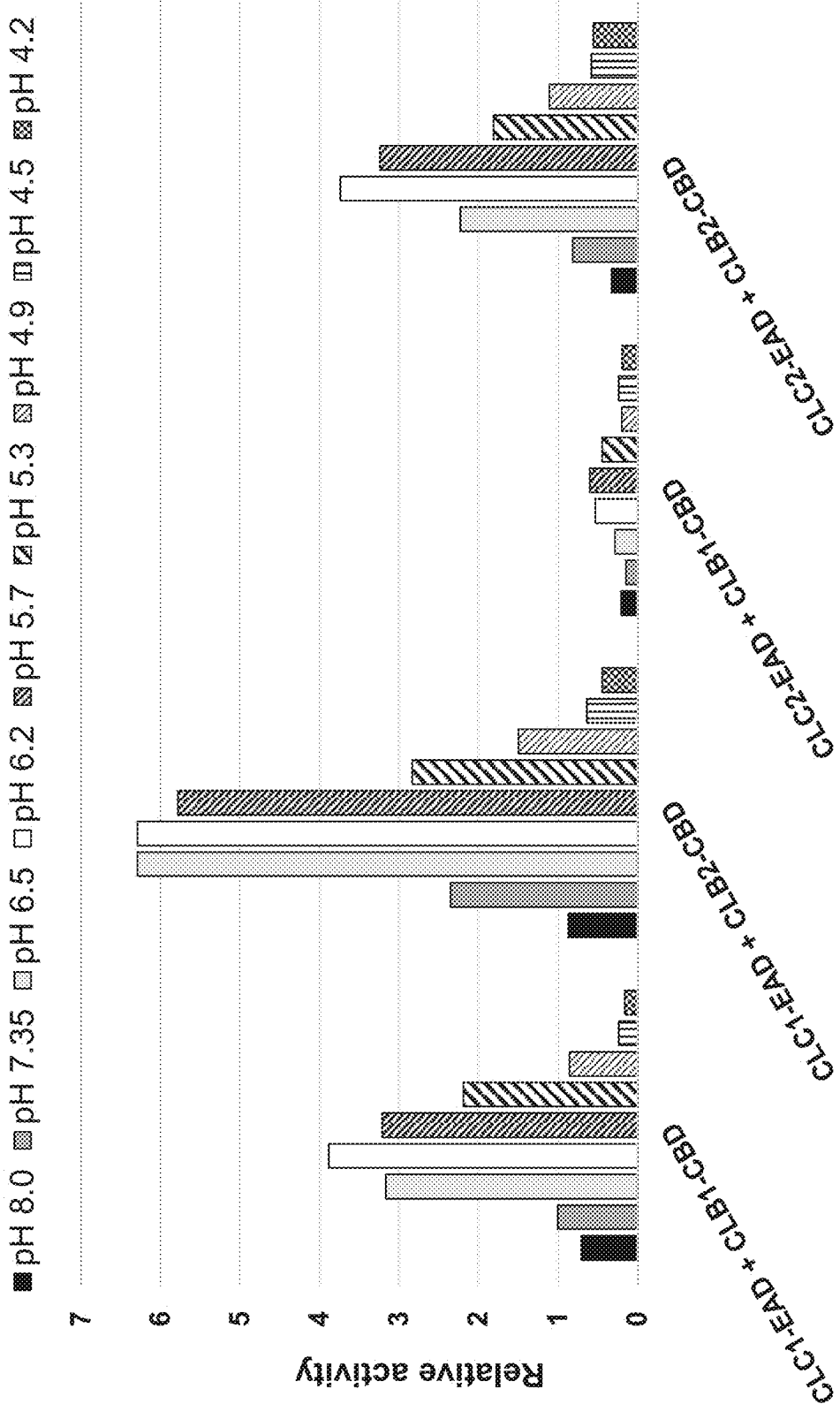
FIG. 12 is a chart showing that the indicated four chimeric proteins are active across a broad range of pH with peak activity at pH~6.
Figure 13A:
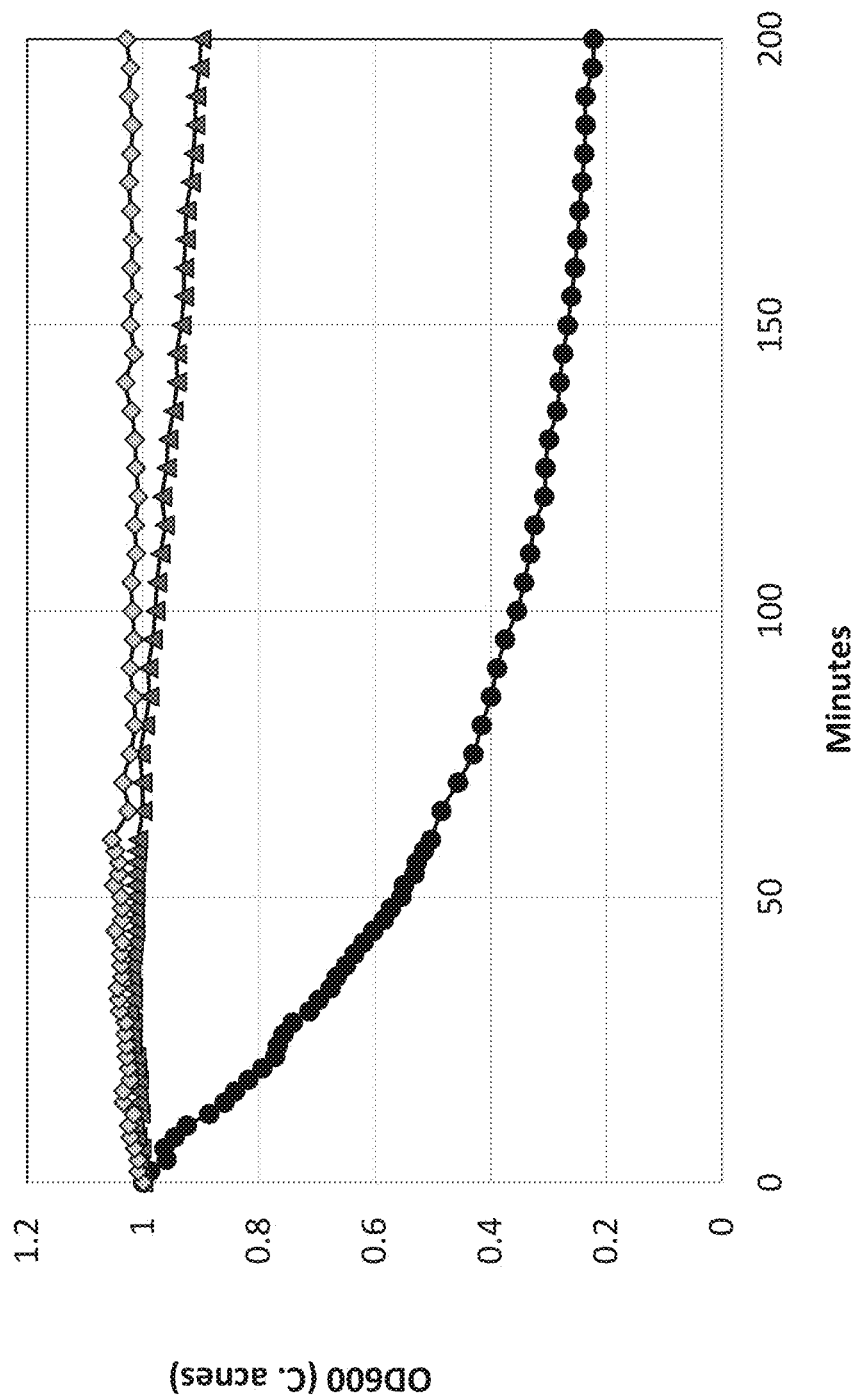
Figure 13B:
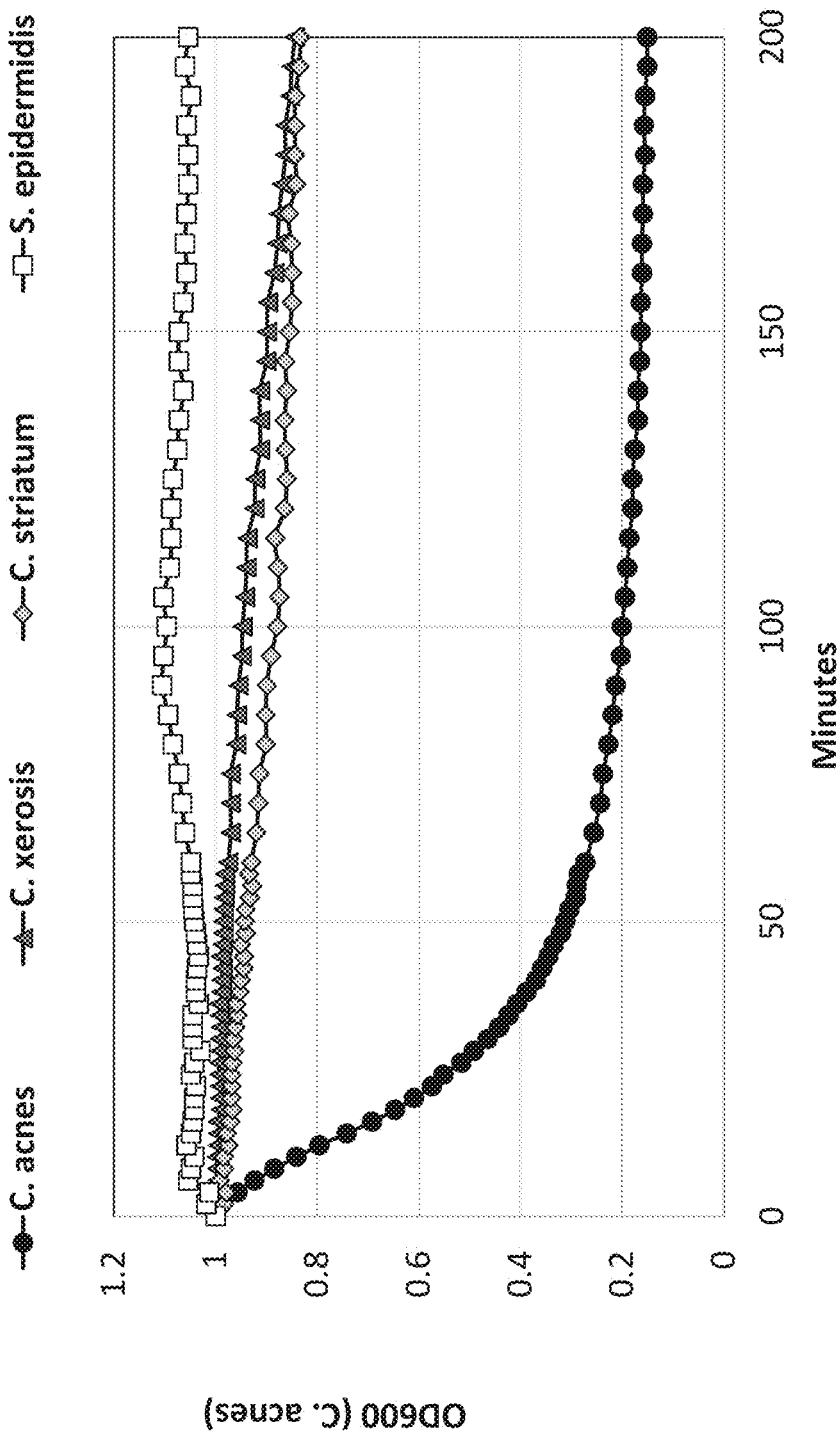
Figure 14C:
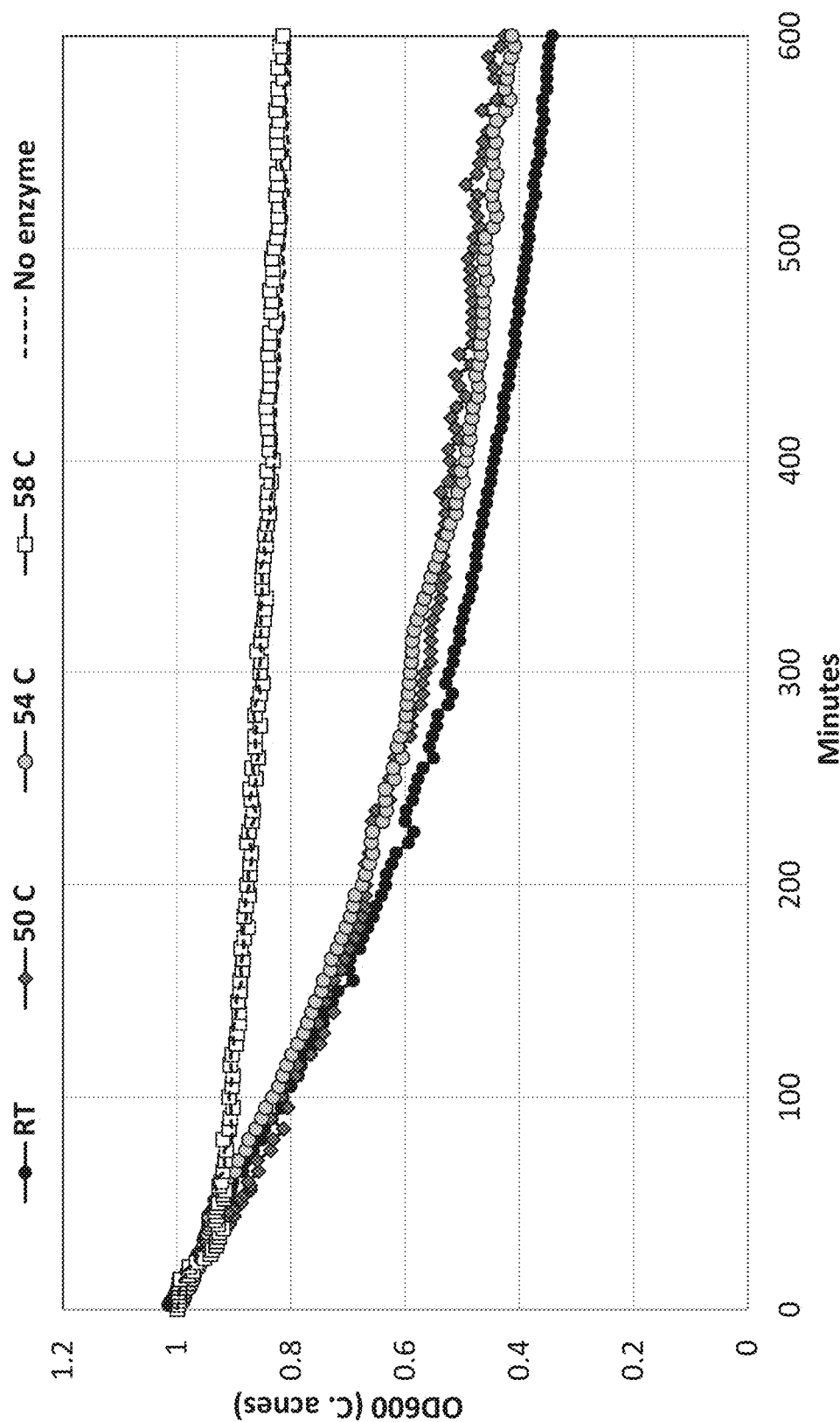

The activity of enzymes can be affected by pH. For commercial applications, it is important that an enzyme is functional at the relevant pH for that application. For example, in the case of a topical skin application, the normal pH of healthy skin is slightly acidic (~pH 5-6). In addition, many topical skin products are formulated to be slightly acidic. Thus, an enzyme that is to be used in these types of applications ideally should be functional at pH 5-6. The well-conserved *C. acnes* endolysin CaLys1, however, has been reported to have peak activity at pH 7 (see WO 2021/175606). Four chimeras of the present application were tested in the turbidity reduction assay at a range of pH 4.2-pH 8.0: CLC1-EAD+CLB1-CBD, CLC1-EAD+CLB2-CBD, CLC2-EAD+CLB1-CBD, and CLC2-EAD+CLB2-CBD. Surprisingly, all four enzymes demonstrated peak lytic activity at pH~6.0 (FIG. 12). Activity was increased approximately 3-fold at pH~6 compared to pH~7.3. Furthermore, the enzymes were active across a very broad range of pH, including the highest pH (8.0) as well as at the lowest pH (4.2) that were tested in this study.

Example 10: Chimeric Proteins Comprising CLC1-Family EADs and CW_7 CBDs Display Strong Selectivity for *C. acnes*

Four chimeric enzymes were tested for genus selectivity: CLC1-EAD+CLB1-CBD, CLC1-EAD+CLB2-CBD, CLC3-EAD+CLB1-CBD, and CLC3-EAD+CLB2-CBD. In particular, these four chimeras were tested for activity on commensal skin bacteria from other genera including *Corynebacterium xerosis*, *Corynebacterium striatum*, and *Staphylococcus epidermidis* using a turbidity reduction assay. In all four cases, strong lytic activity was observed against *C. acnes*, but none of the other commensal skin bacteria tested, demonstrating that these chimeric proteins have the ability to lyse target bacteria relevant for *acnes vulgaris* without damaging important commensal skin bacteria (FIG. 13A-13D).

Example 11: Chimeric Proteins Comprising CLC1-Family EADs and CW_7 CBDs Display Significant Thermostability Thermostability is an important factor in commercial applications. The thermostability of these chimeric enzymes was tested by incubating aliquots of proteins for 30 min at a range of temperatures and then measuring the remaining lytic activity in the aliquot in the turbidity reduction assay at room temperature (FIG. 14A-14D). The results showed that the CLC1-EAD+CLB1-CBD chimera retained activity until incubation at 50° C. The CLC1-EAD+CLB2-CBD chimera demonstrated higher thermostability, retaining some activity until incubation at 54° C. The two CLC3 EAD chimeric enzymes displayed even higher thermostability, with the CLC3-EAD+CLB1-CBD chimera retaining activity until incubation at 58° C. and the CLC3-EAD+CLB2-CBD chimera retaining some activity even at the highest temperature tested (58° C.).

Figure 15:
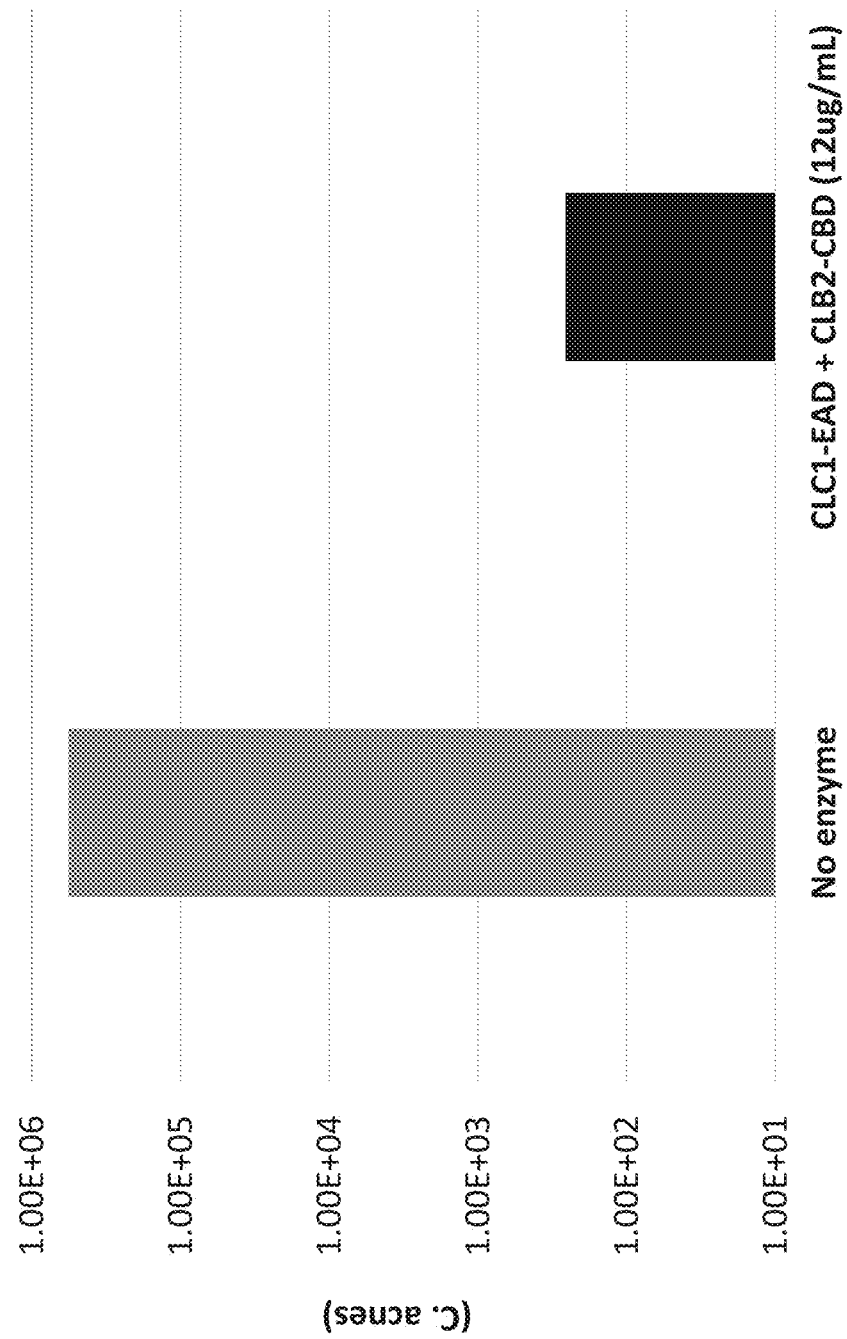
FIG. 15 is a chart showing the CFU of *C. acnes* cells under indicated conditions in a quantitative killing assay. Six-hour incubation with CLC1-EAD+CLB1-CBD resulted in >3 orders of magnitude decrease in viable *C. acnes* cells.

Example 12: Quantitative Killing Assay Demonstrates Significant *C. acnes* Lytic Activity by the CLC1-EAD+CLB1-CBD Chimera The turbidity reduction assay measures lysis of *C. acnes* through an observed decrease in optical density. A more direct method to measure antibacterial activity is to use a quantitative killing assay. In this assay, antibacterial activity is measured via the decrease in viable cells after incubation with an enzyme. Specifically, ~1×10⁶ *C. acnes* cells were incubated with and without the enzyme being tested for 2-6 hours, at which point serial dilutions of the mix are plated on BHI agar plates and CFU are quantified. The CLC1-EAD+CLB1-CBD chimera was tested in this assay. The result shows that the number of viable C. acnes cells were reduced by 3 orders of magnitude after a 6-hour incubation (FIG. 15).

Example 13: Chimeric CWHs Comprising the Broader CLC1 Family of EADs in Combination with CLB2 CBD Exhibit Lytic Activity Against C. acnes To test the activity level of the broader CLC1-family of amidase proteins and their ability to function as components of chimeric cell wall hydrolases, chimeric enzymes were constructed by linking the CLC4-CLC17 EADs to the CLB2 CBD. The CLC18 EAD and the CLC19 EAD have identical amino acid sequences to the CLC13 EAD and were thus not separately included.

Figure 16A:
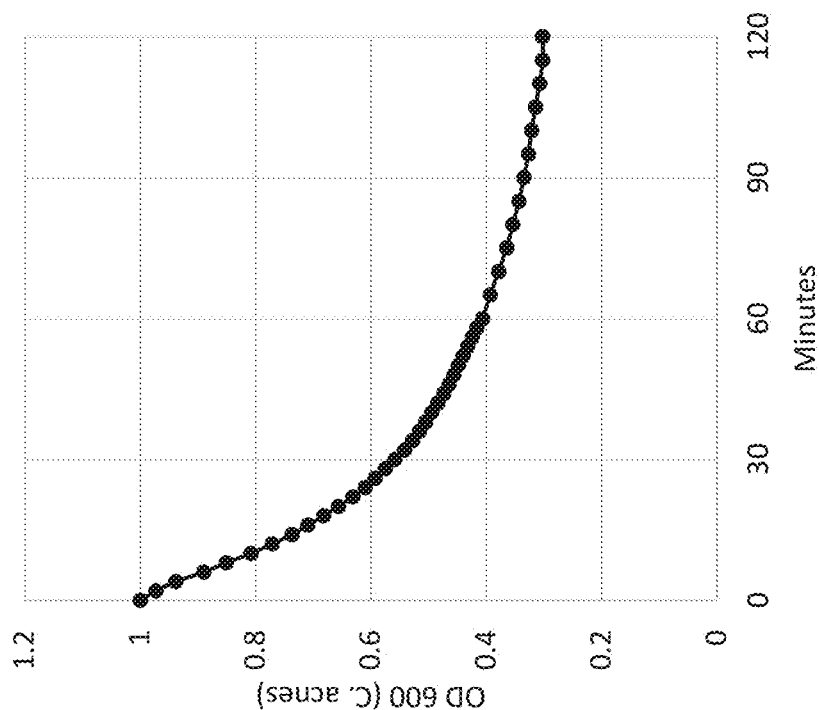
FIG. 16A-16F show the results of turbidity reduction assays against *C. acnes* for six chimeric proteins of the disclosure: CLC4-EAD+CLB2-CBD (FIG. 16A); CLC5-EAD+CLB2-CBD (FIG. 16B); CLC8-EAD+CLB2-CBD (FIG. 16C); CLC10-EAD+CLB2-CBD (FIG. 16D); CLC14-EAD+CLB2-CBD (FIG. 16E); and CLC16-EAD+CLB2-CBD (FIG. 16F).
Figure 16B:
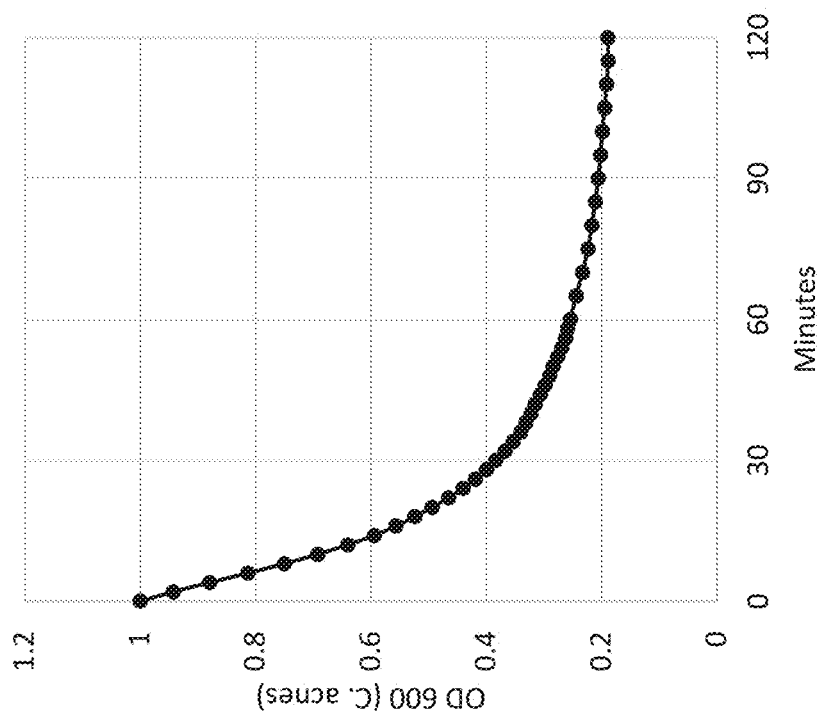
Figure 16D:
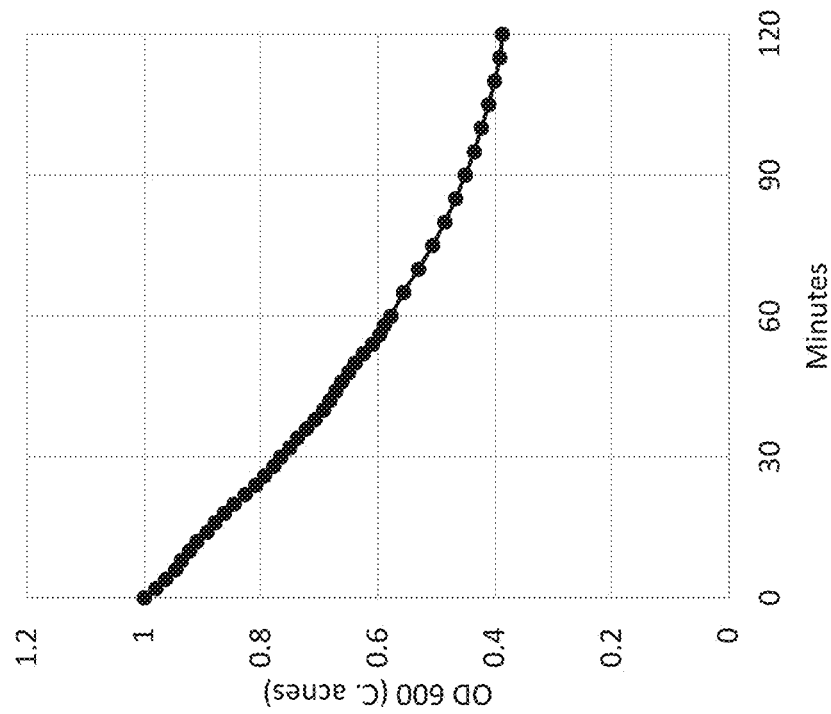
Figure 16C:
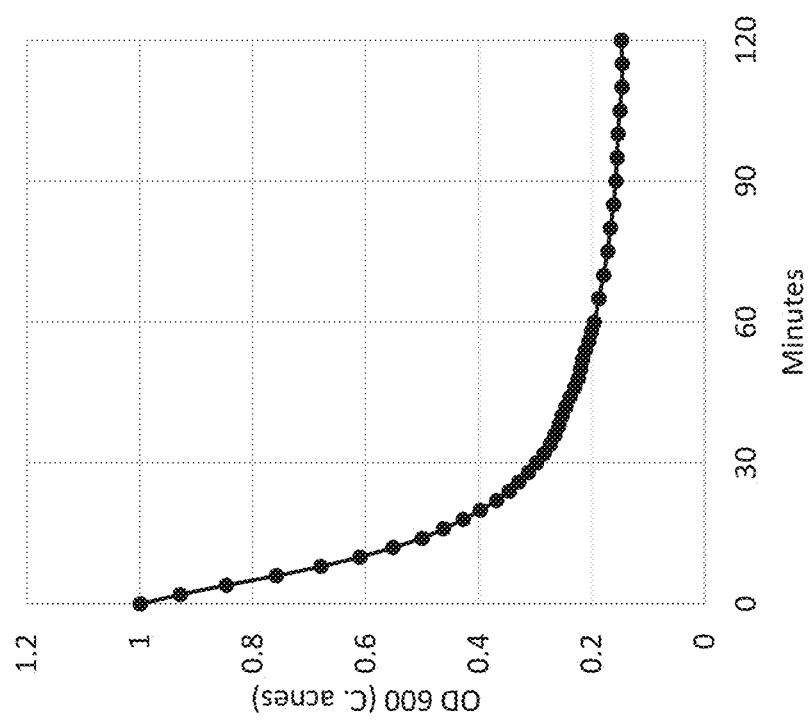
Figure 16E:
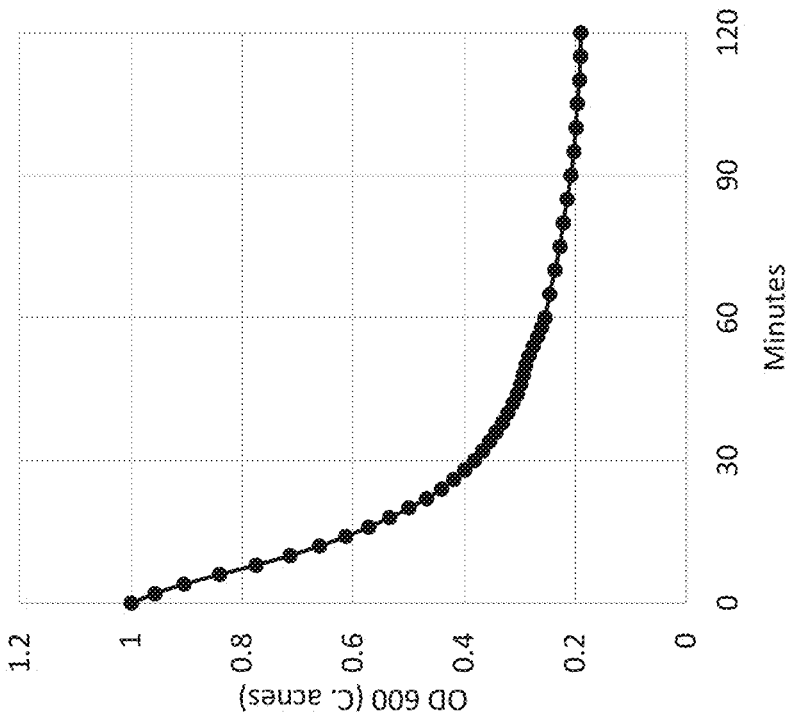
Figure 16F:
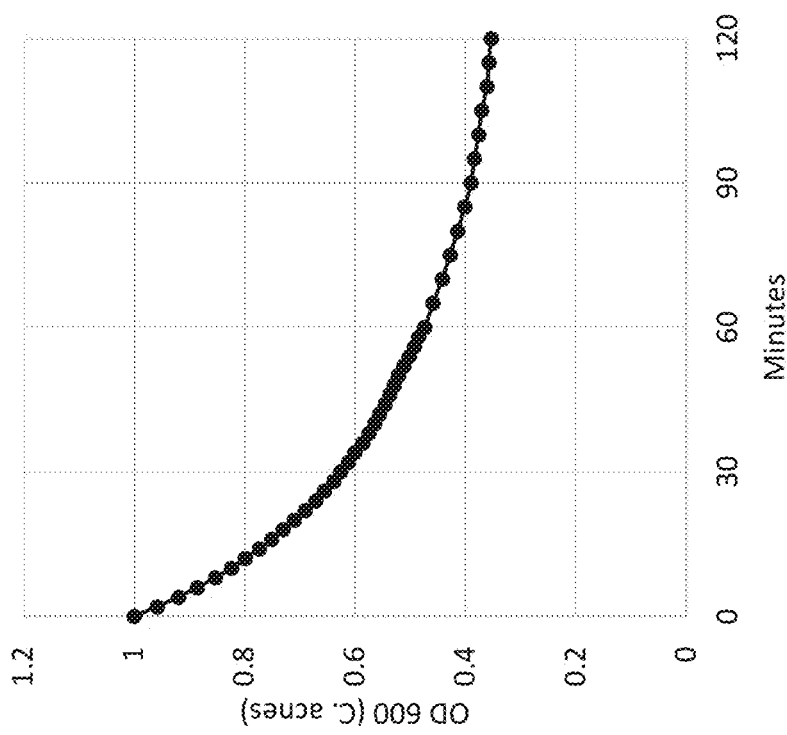
Figure 16G:
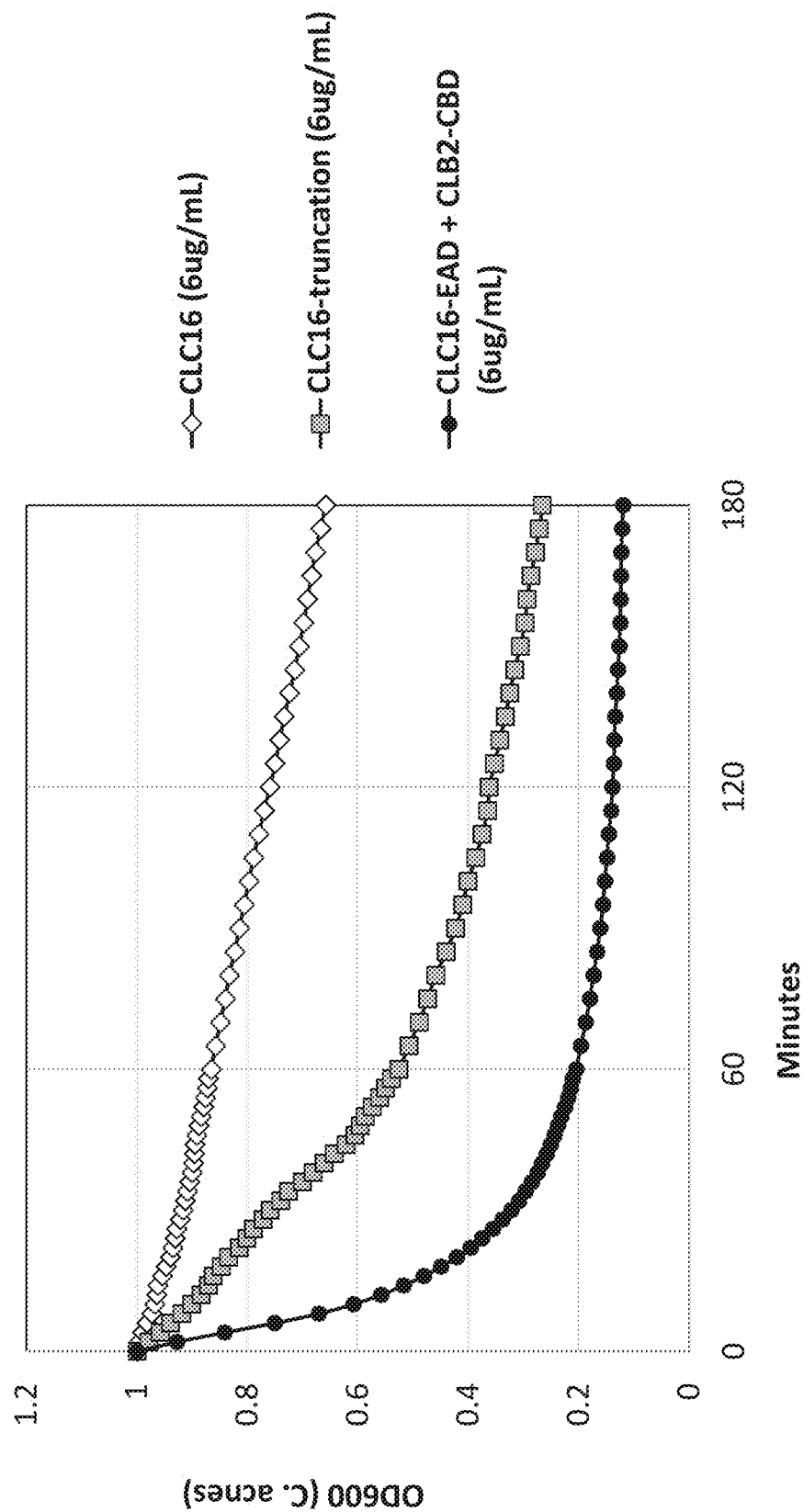
FIG. 16G shows turbidity reduction assay results for the CLC16-EAD+CLB2-CBD chimera in comparison with full length CLC16 and CLC16-truncation.

Expression vectors containing the cloned CLC1-family EAD+CLB2 CBD chimeric CWHs were transformed into BL21 E. coli cells. Protein expression was induced, and cell lysate was isolated for each chimeric enzyme. These cell lysates were tested for lytic activity against C. acnes using a clearing/halo assay. In this assay, six of the tested lysates generated a significant clearing indicative of C. acnes lytic activity. These lysates comprised chimeric CWHs comprising the CLB2 CBD in combination with the EAD from CLC4, CLC5, CLC8, CLC10, CLC14, or CLC16. To confirm these results, these chimeric proteins were purified and tested in a turbidity reduction assay (FIG. 16A-16F). Proteins were tested at 12 µg/mL. All six chimeric proteins showed strong lytic activity against C. acnes, confirming the results from the clearing assay. In a further turbidity reduction assay, it was also demonstrated that the CLC16-EAD+CLB2-CBD chimera outperformed both full-length CLC16 and the higher activity CLC16-truncation in terms of anti-C. acnes lytic activity (FIG. 16G).

These active CLC1-family EADs range from 77%-96% amino acid identity with each other (FIG. 17) and demonstrate the utility of the broader CLC1-family of proteins as sources of highly active EADs that can target C. acnes.

Example 14: Chimeric CWHs Comprising CLC1-Family EADs and CLB2 CBD Exhibit Significant Thermostability The thermostability of chimeric proteins comprising CLC1-family EADs was characterized. The thermostability of the proteins was measured by incubating aliquots of purified chimeric protein for 30 minutes at the indicated temperatures. The lytic activity of the incubated enzyme was then measured using a turbidity reduction assay against C. acnes and calculated relative to activity after room temperature incubation.

Figure 18A:
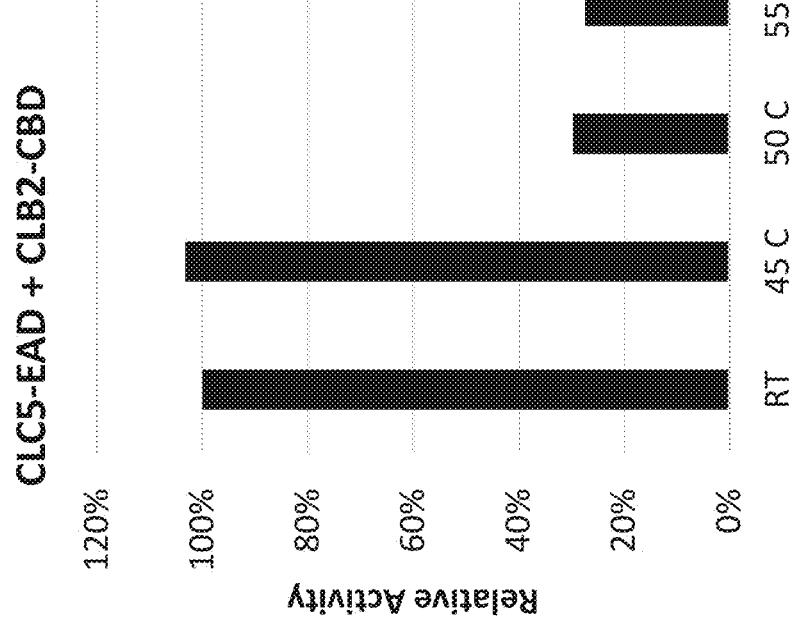
FIG. 18A-18F show the results of thermostability assays for six chimeric proteins of the disclosure: CLC4-EAD+CLB2-CBD (FIG. 18A); CLC5-EAD+CLB2-CBD (FIG. 18B); CLC8-EAD+CLB2-CBD (FIG. 18C); CLC10-EAD+CLB2-CBD (FIG. 18D); CLC14-EAD+CLB2-CBD (FIG. 18E); and CLC16-EAD+CLB2-CBD (FIG. 18F).
Figure 18B:
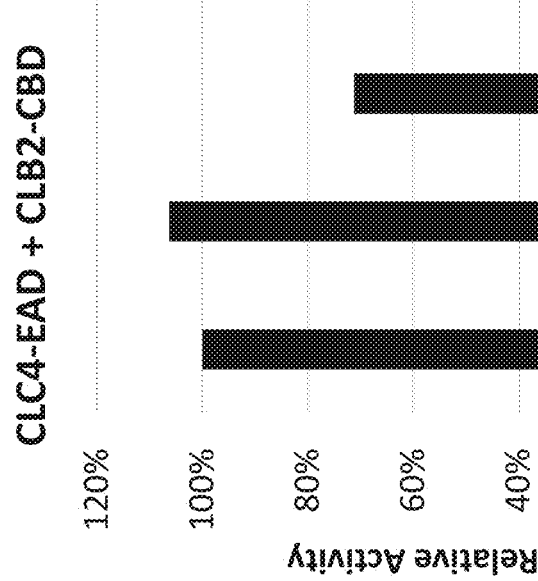
Figure 18C:
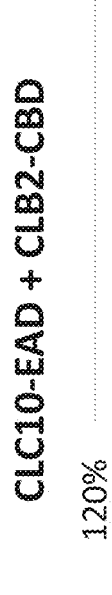
Figure 18D:
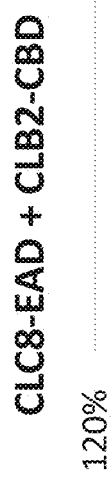
Figure 18E:
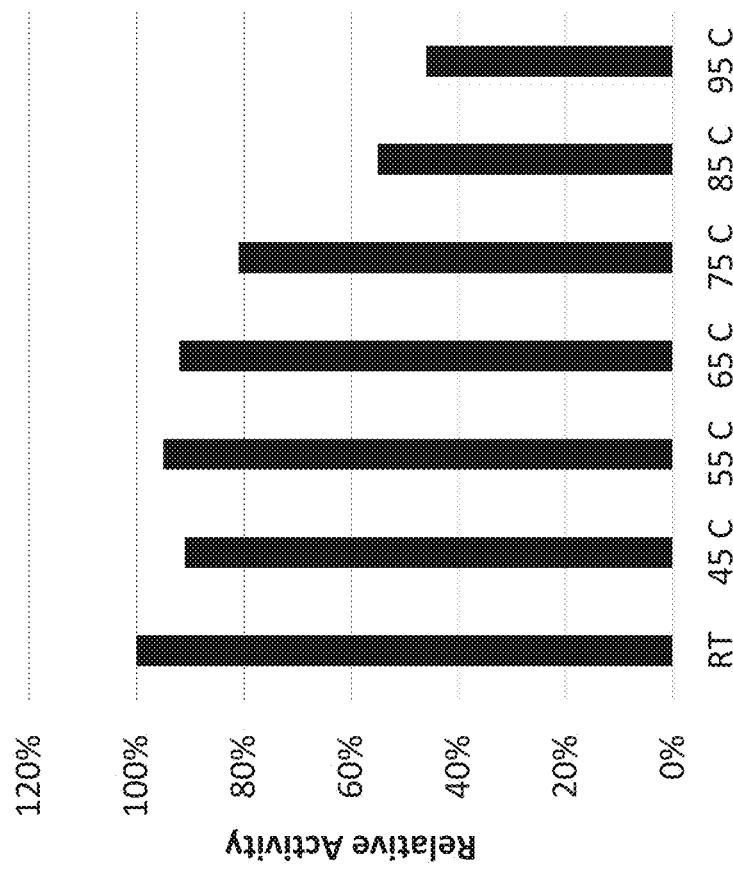
Figure 18F:
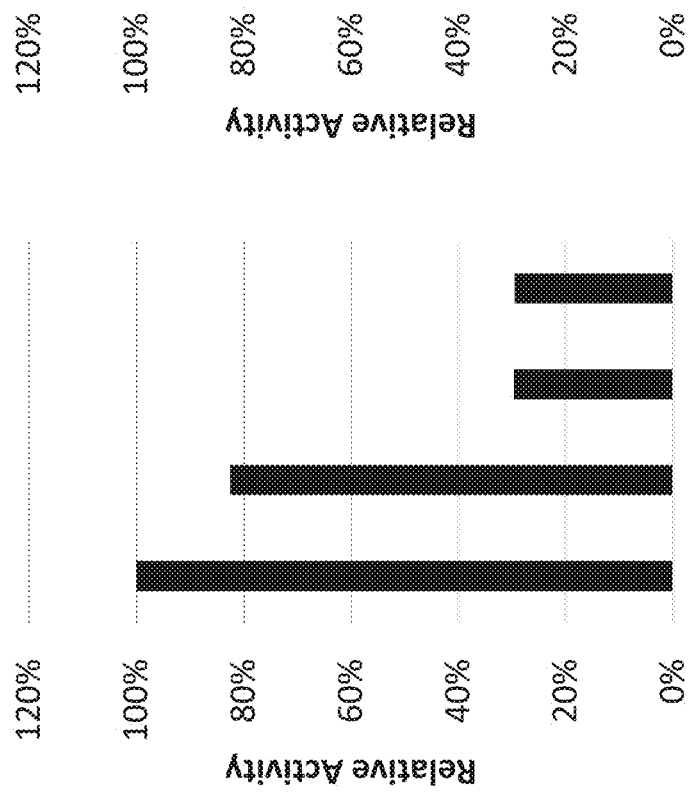

Results are shown in FIG. 18A-18F. All six proteins retained significant activity after exposure to 45° C. Chimeric CWHs comprising the EAD from CLC4, CLC5, CLC8, CLC10, and CLC14 demonstrated loss of activity after 30-minute incubation between 50° C.-55° C., similar to the CLC1-EAD, CLC2-EAD, and CLC3-EAD chimeric proteins. Surprisingly, the CLC16-EAD+CLB2-CBD chimeric protein showed extraordinary thermostability, retaining greater than 80% activity after a 30 minute incubation at 75° C., and retaining greater than 40% activity even after 30 minutes incubation at 95° C. (FIG. 18F).

Figure 19:
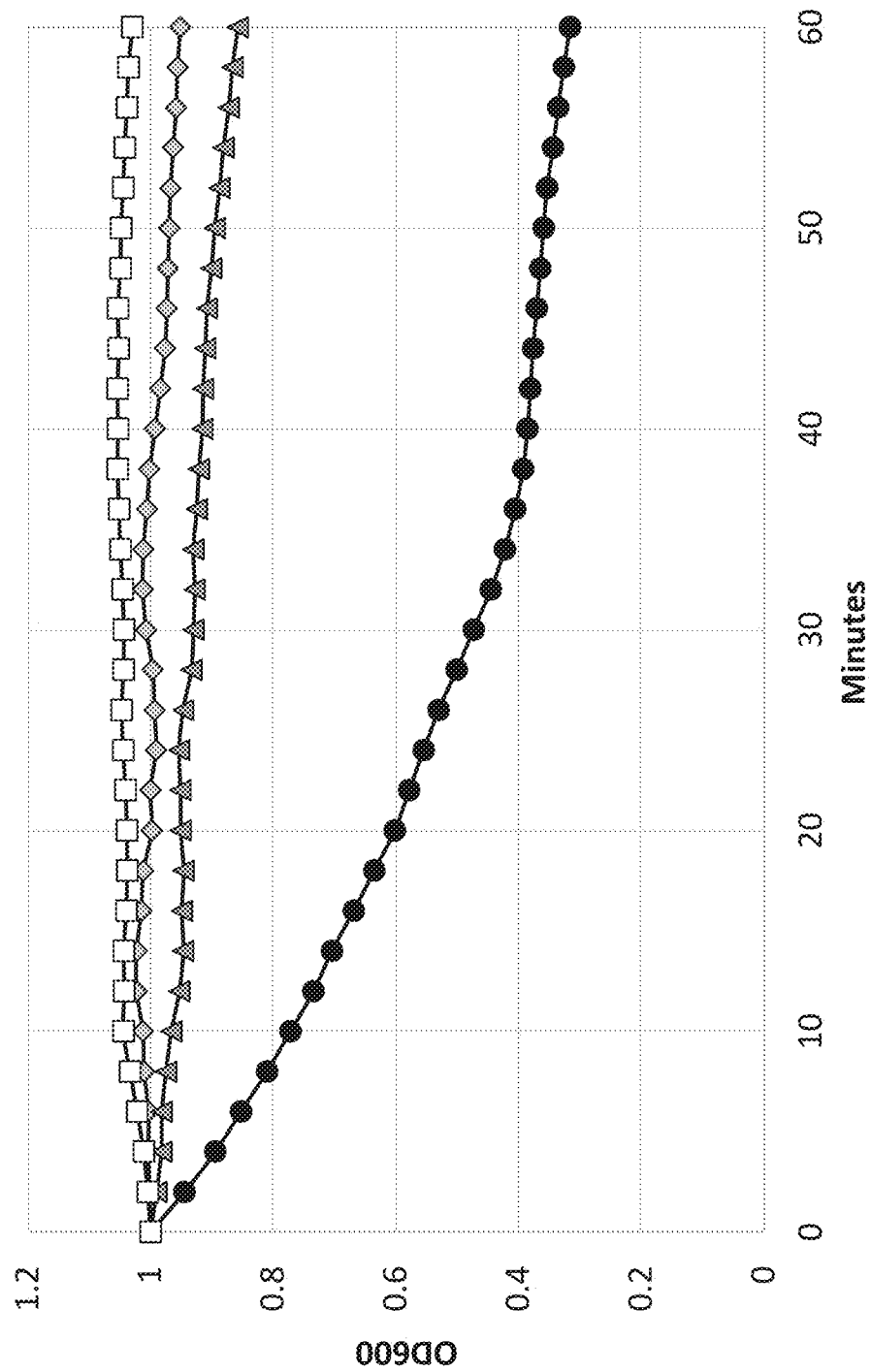
FIG. 19 shows the results of turbidity reduction assays against *C. acnes* and three other commensal strains of bacteria for the CLC16-EAD+CLB2-CBD chimeric protein.
Figure 20B:
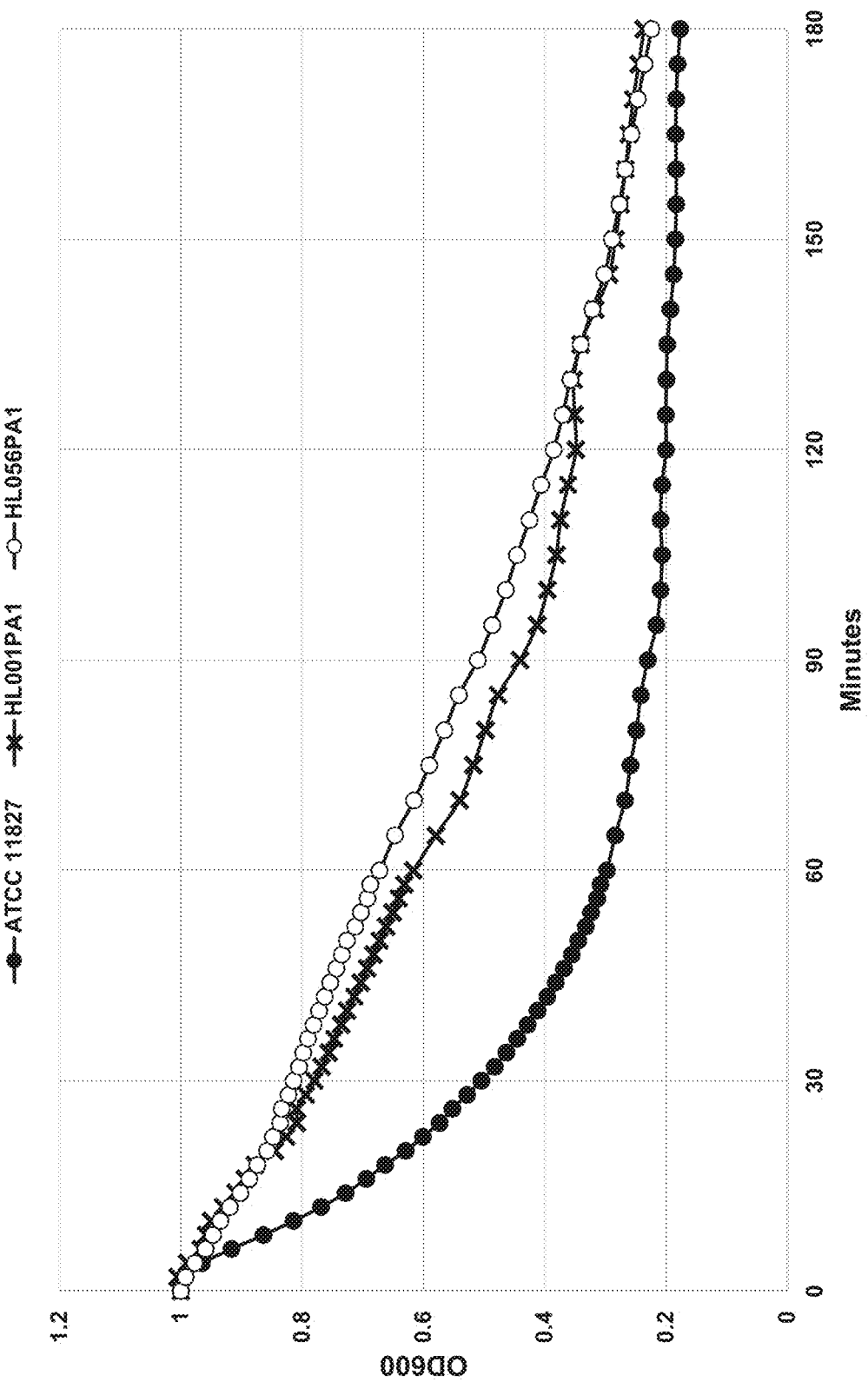
Figure 20C:
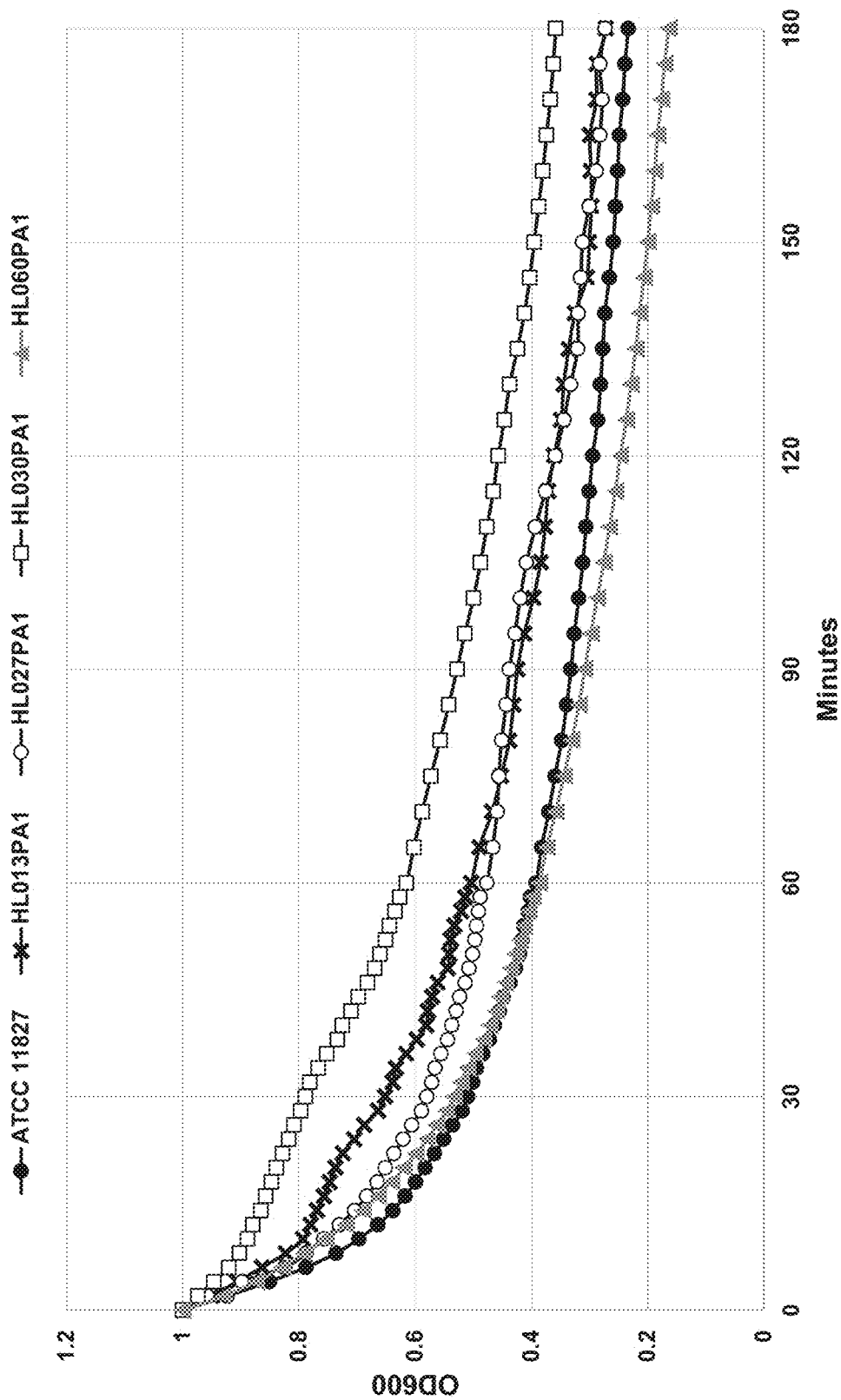
Figure 20D:
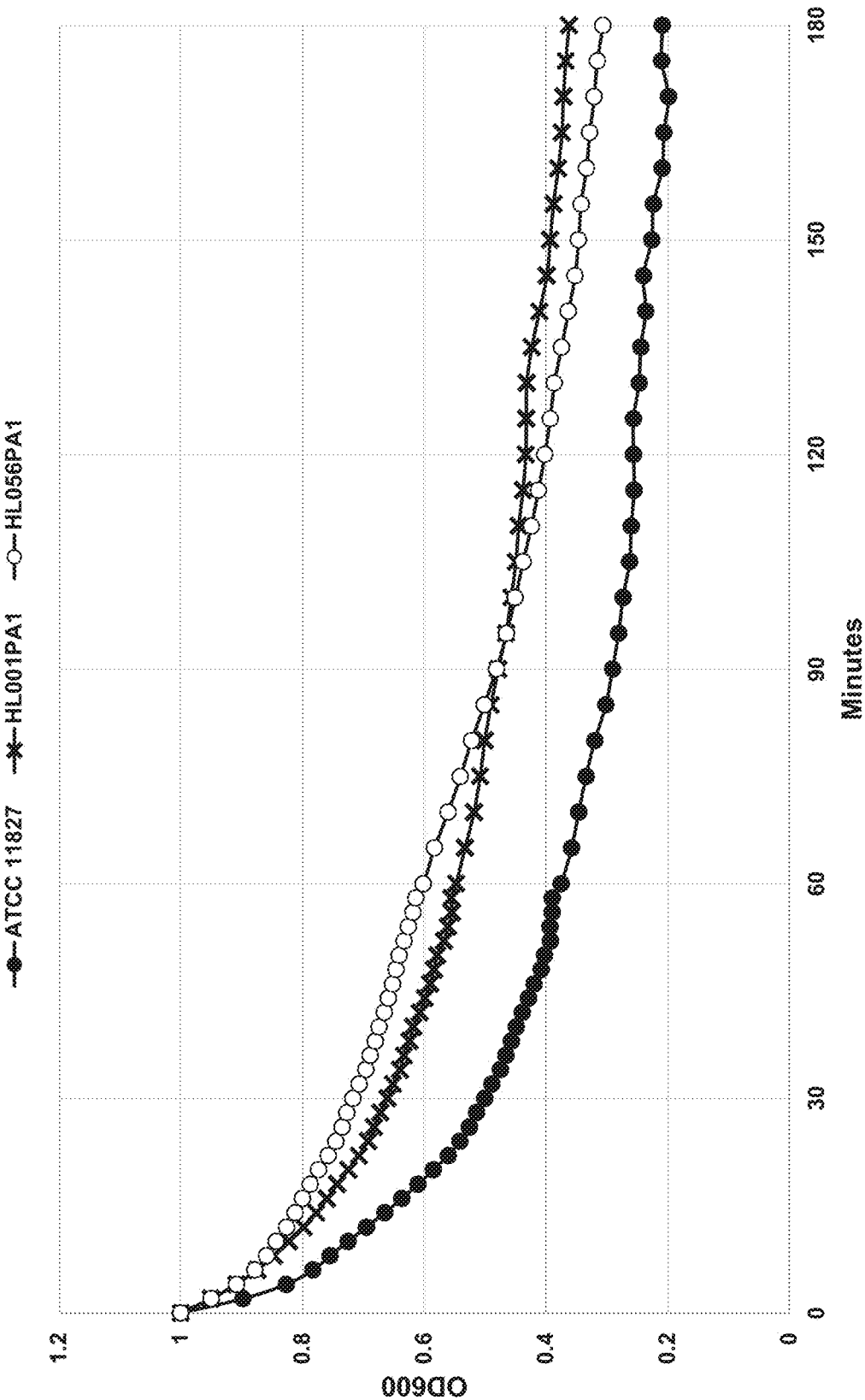

Example 15: CLC16 EAD+CLB2 CBD Chimera Exhibits Strong Selectivity for C. acnes Over Commensal Skin Bacteria The CLC16-EAD+CLB2-CBD chimeric CWH was tested for lytic activity against C. acnes and three commensal skin bacteria—C. xerosis, C. striatum, and S. epidermidis—in a turbidity reduction assay. The CLC16-EAD+CLB2-CBD chimeric CWH showed strong, selective activity for C. acnes over the three other bacteria (FIG. 19).

Example 16: CLC1-EAD+CLB2-CBD and CLC16-EAD+CLB2-CBD Chimeric Enzymes are Active Against a Broad Panel of *Cutibacterium acnes* Strains and Phylotypes C. acnes strains can be categorized into five major phylotypes (IA1, IA2, IB, II and III) based on phylogenetic analysis, such as the use of a multilocus sequence typing (MLST) scheme. See, e.g., McDowell et al., Plos One 2012; 7(7): e41480. Phylotypes IA1 and IA2 are most often associated with acne lesions.

To assess the activity of the CLC1-EAD+CLB2-CBD and CLC16-EAD+CLB2-CBD chimeric enzymes against different strains of C. acnes, these enzymes were tested in turbidity reduction assays against a panel of C. acnes strains from a variety of phylotypes (Table 12).

TABLE 12

| C. acnes strains and phylotypes. | |
|---|---|
| Strain | Phylotype |
| ATCC 11827 | IA1 |
| HL001PA1 (HM-488) | II |
| HL013PA1 (HM-497) | IA2 |
| HL027PA1 (HM-502) | IA2 |
| HL030PA1 (HM-504) | IB |
| HL056PA1 (HM-524) | IA1 |
| HL060PA1 (HM-527) | II |

Results are shown in FIG. 20A-20D. Both the CLC1-EAD+CLB2-CBD and CLC16-EAD+CLB2-CBD chimeric enzymes exhibited strong lytic activity against every tested C. acnes strain, indicating that these chimeric enzymes are active against a broad set of C. acnes strains and phylotypes.

Example 17: The CBD from CLB2 Increases the Enzymatic Activity of the CaLys1 EAD The well-conserved CaLys1 endolysin that is commonly found in C. acnes phage genomes has been characterized as having weak lytic activity, often requiring concentrations of greater than 100 mg/mL to see activity. This activity has also been observed to be largely non-specific, e.g., demonstrating similar levels of activity against S. aureus as against C. acnes. See Varotsou C et al., Int J Mol Sci 2023 May 10; 24(10):8523. In order to test whether the CLB2-CBD could improve the activity and specificity of the CaLys1-EAD, a CaLys1-EAD+CLB2-CBD chimeric CWH was generated. The CaLys1-EAD+CLB2-CBD chimeric CWH was expressed and purified, as well as the native CaLys1 protein. The lytic activity of the chimera was compared to the native protein in turbidity reduction assays against C. acnes, C. striatum, and S. aureus. These assays utilized a concentration of 12 µg/mL of each protein.

Figure 21B:
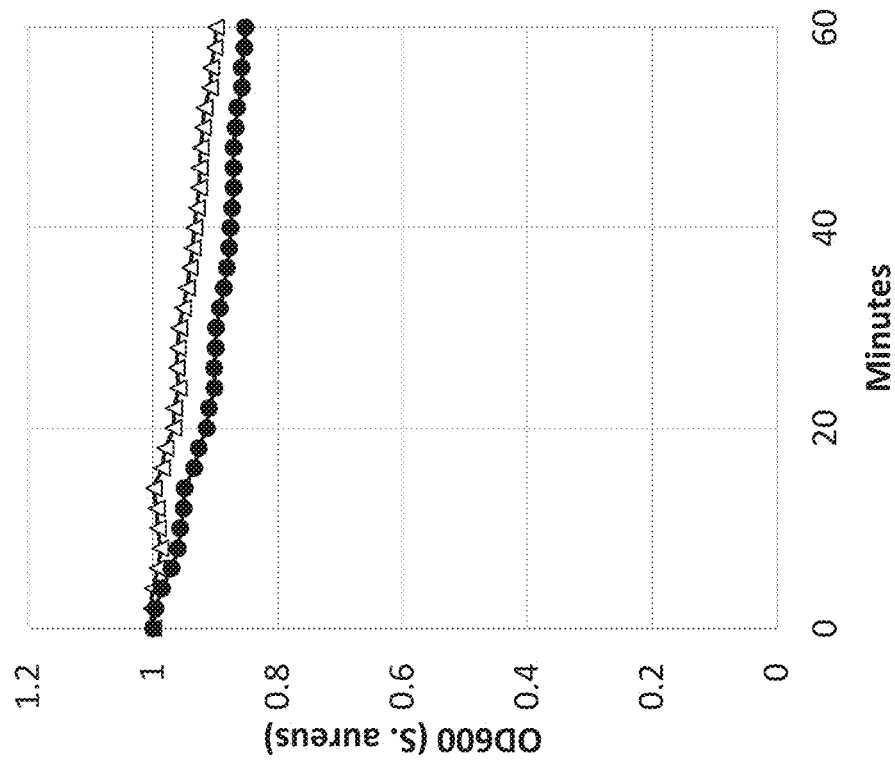
Figure 21C:
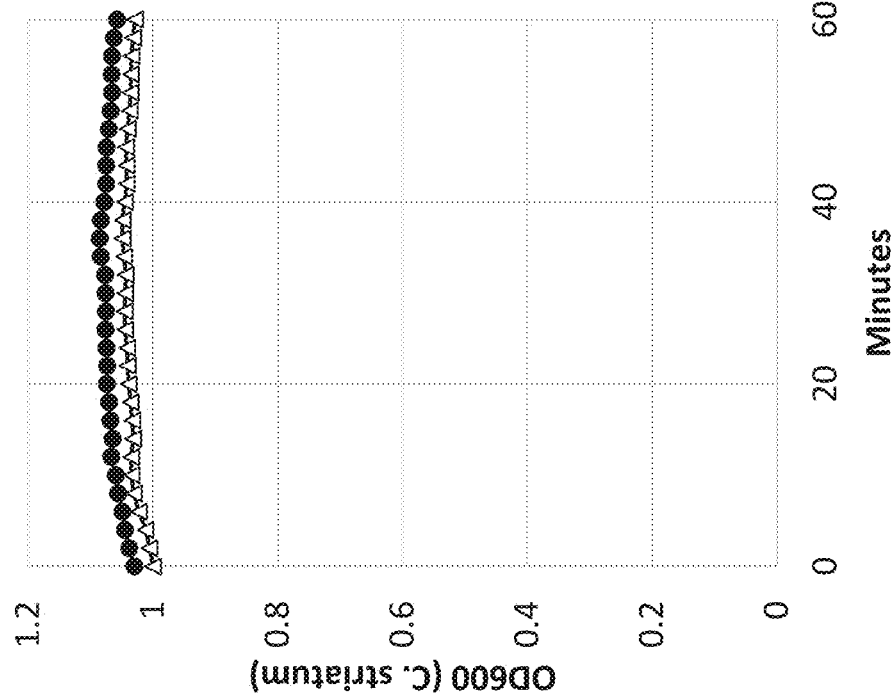
Figure 22:
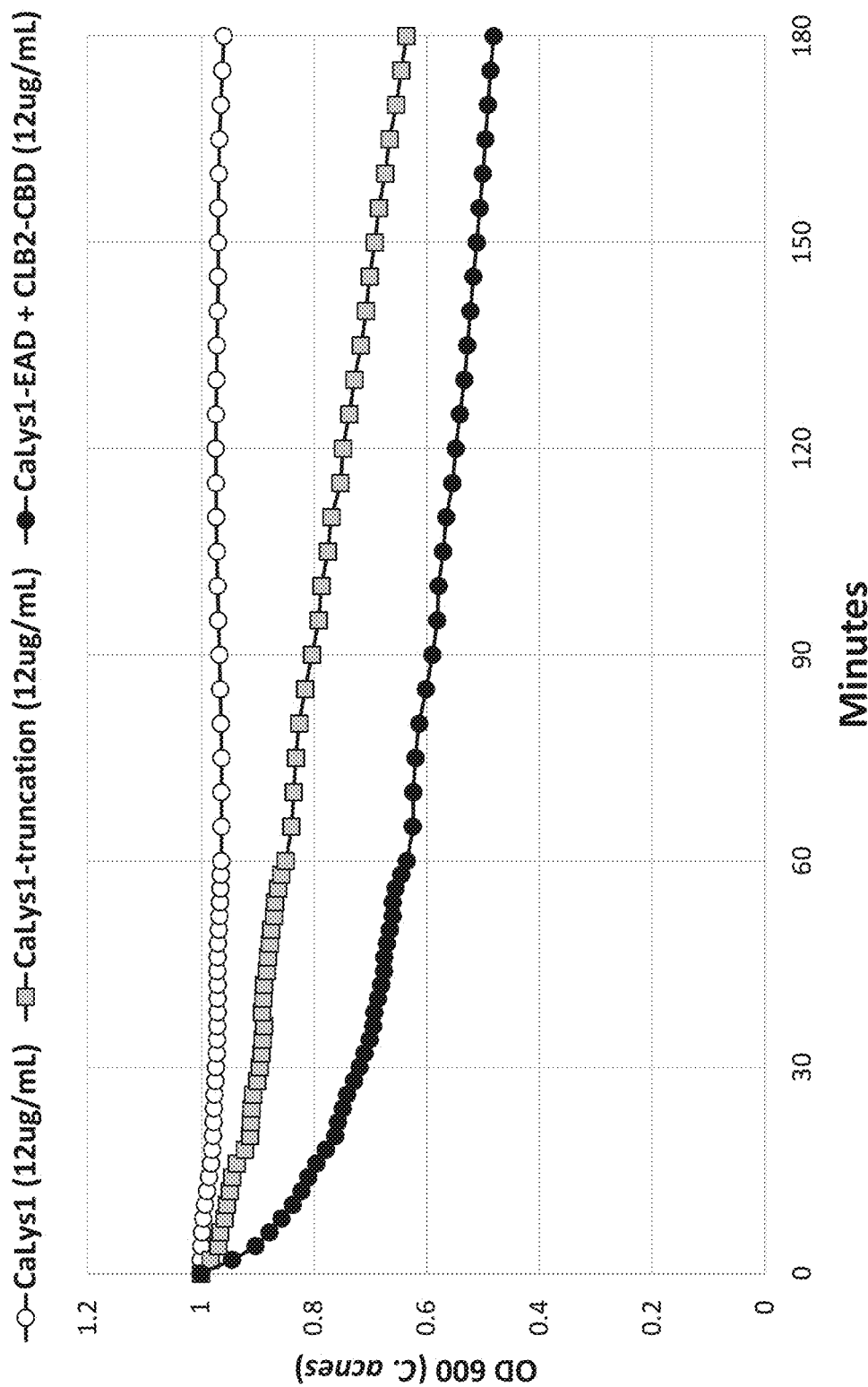
FIG. 22 shows the results of a turbidity reduction assay against *C. acnes* for full length CaLys1, the CaLys1-truncation, and the CaLys1-EAD+CLB2-CBD chimeric protein.

Results are shown in FIG. 21A-21C. At this low concentration, CaLys1 had no detectable lytic activity against any of the three bacteria. In contrast, the CaLys1-EAD+CLB2-CBD chimeric CWH showed strong lytic activity against *C. acnes* and no detectable lytic activity against *C. striatum* and *S. aureus*. These data demonstrate that a CBD derived from the CLB1-CLB4 proteins was able to increase the *C. acnes*-specific lytic activity of the canonical CaLys1 EAD in a chimeric CWH. While CaLys1 is reported to have equivalent lytic activity against *C. acnes* and other bacteria such as *S. aureus*, a chimeric CWH comprising the CLB2-CBD in combination with the CaLys1-EAD exhibited increased *C. acnes*-specific lytic activity without increasing *C. striatum* or *S. aureus* lytic activity. In a further turbidity reduction assay, it was also demonstrated that the CaLys1-EAD+CLB2-CBD chimera exhibited increased anti-*C. acnes* lytic activity compared to both full-length CaLys1 and the higher activity CaLys1-truncation (FIG. 22).

Figure 23B:
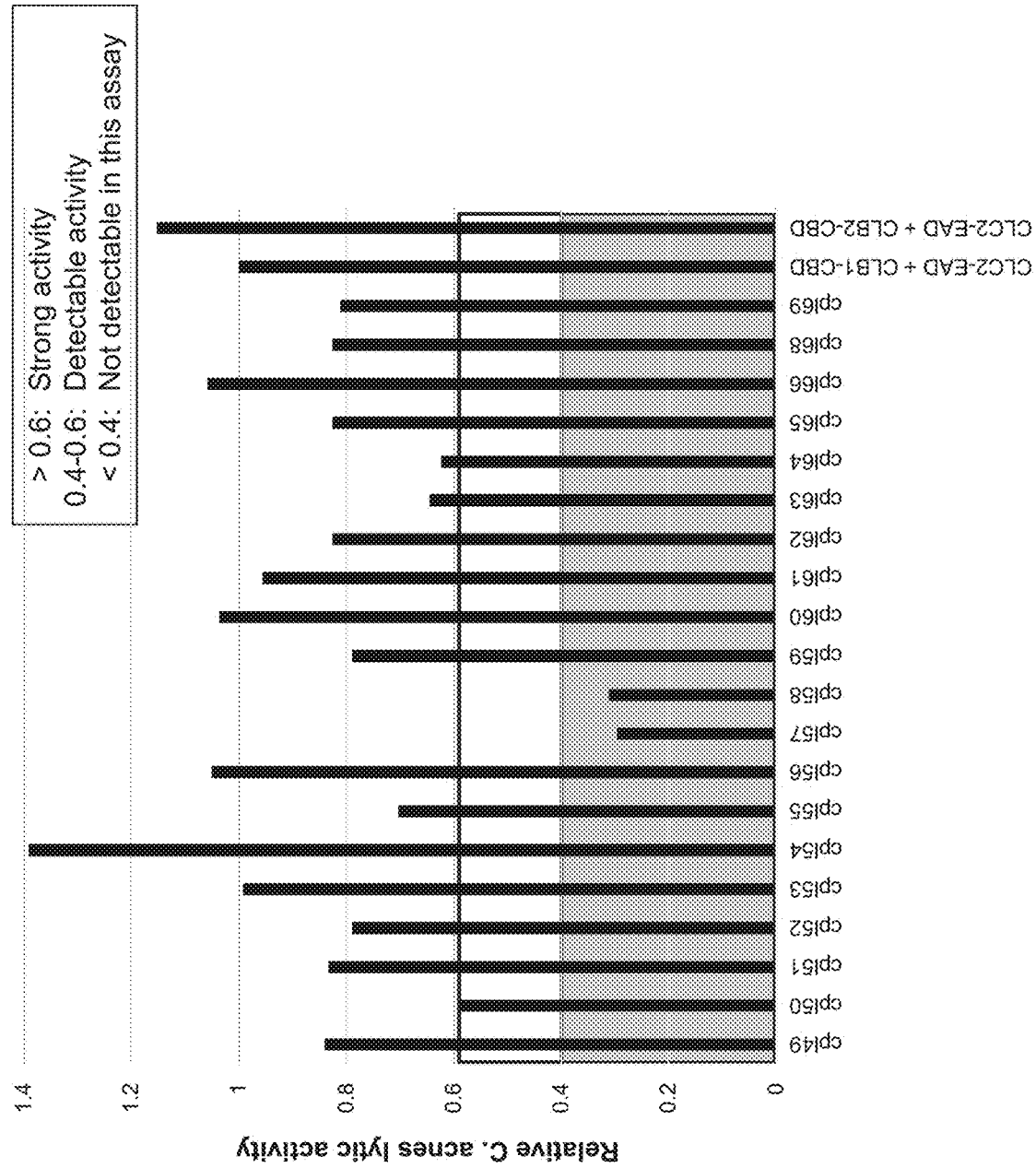
FIG. 23B shows the result of whole cell lysate screening of additional diverse CW_7 CBD comprising chimeras in a turbidity reduction assay.

Example 18: Diverse CW_7 Repeats are Able to Facilitate Binding and Lysis of *C. acnes* in Chimeric CWHs in Whole Cell Lysate Screen To test the ability of diverse CW_7-containing CBDs to target *C. acnes* in chimeric CWHs, sixty-seven CBDs were selected from the broad range of bacterial species and viruses identified in Example 6. These CBDs contained one to four CW_7 repeats, ranging from 58.5%-89% amino acid identity to the CLB2-CBD CW_7 sequence. EADs associated with these CBDs included both amidases and glycohydrolases. Chimeric proteins were generated that comprised the CLC2-EAD in combination with each of these CW_7-comprising CBDs. These proteins were expressed in BL21 *E. coli* cells. Whole cell culture lysates were tested for *C. acnes* lytic activity in a turbidity reduction assay. Activity was measured relative to the activity of the CLC2-EAD+CLB2-CBD chimeric CWH. Results are shown in FIG. 23A-23B. Of the sixty-seven CBDs tested, nine were categorized as having no detectable activity in this assay (relative activity <0.4), possibly due to solubility or assay format; nine had "detectable activity" (relative activity between 0.4 and 0.6); and 49 were categorized as having "strong activity" (relative activity >0.6).

The CBDs found to have "strong" or "detectable" activity were comprised of CW_7 repeats that ranged anywhere from 58.5%-89% AA ID to the CLB2-CBD CW_7 and come from a broad range of bacterial species (Table 13). Chimeras comprising a wide variety of these CBDs exhibited activity similar to the activity observed for the highly active CLC2-EAD+CLB2-CBD chimera. These data indicate that, surprisingly, the *C. acnes*-specific lytic activity of EADs can be improved by combining EADs with a wide variety of CW_7 repeat-containing CBDs, irrespective of taxonomic source or amino acid identity to the CLB2-CBD.

Figure 23C:
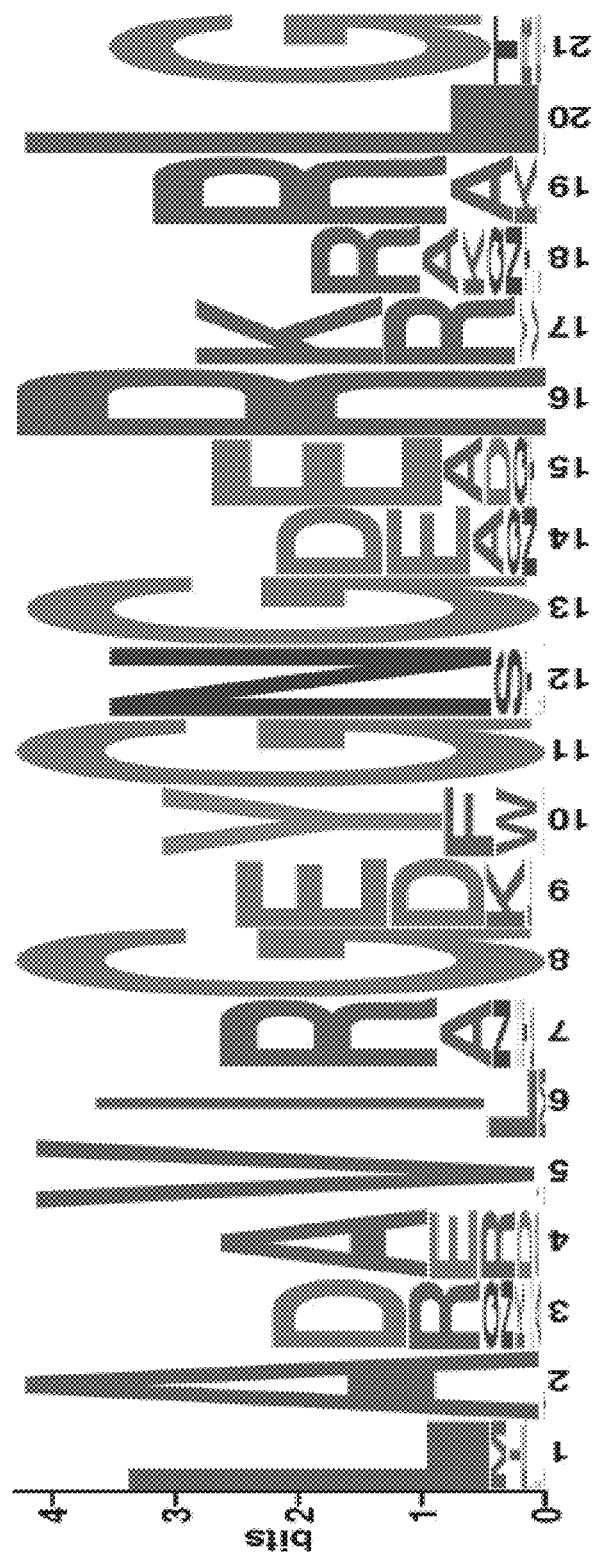
FIG. 23C visually depicts a sequence motif shared by CW_7 repeats exhibiting anti-*C. acnes* activity in chimeric combination with CLC2-EAD.

The CW_7 repeat sequences from the CBDs with strong or detectable activity were compiled and bioinformatically analyzed using MEME (see Bailey et al., "The MEME Suite," *Nucleic Acids Research*, 2015; 43(W1): W39-W49), a bioinformatic tool that discovers novel, ungapped sequence motifs in nucleotide and protein sequences. MEME identified two similar amino acid motifs characteristic of the analyzed CBDS. The 21-amino-acid motif contains 12 highly conserved residues, while the 19-amino-acid motif contains 10 highly conserved residues, that exemplify CW_7 repeats found in CBDs that can be utilized in chimeric cell wall hydrolases to increase activity against *C. acnes*. FIG. 23C visually represents the relative frequency of amino acids at each position of this conserved stretch of the CW_7 repeat sequences characterized in this example. The identified motif sequences are as follows:

```
CW_7-21-motif:
                                           (SEQ ID NO: 2940)
L A X X V I/L X G X X G N/S G X X R K/R X X L G;
and CW_7-19-motif:
                                           (SEQ ID NO: 2941)
A X X V I/L X G X X G N/S G X X R K/R X X L.
```

TABLE 13

CW_7 repeat sequences, source protein, taxonomy and sequence identity to the CLB2-CBD CW_7 repeat.

| Label | Activity Level* | GenBank Acc. # | Phylum | Taxonomy | AA ID %** | Protein SEQ ID | CBD SEQ ID | Chimera SEQ ID |
|---|---|---|---|---|---|---|---|---|
| CPL01 | Strong | HAT1491020.1 | Actinobacteria | *Corynebacterium striatum* | 89.47 | 108 | 166 | 224 |
| CPL02 | Strong | KDS92380.1 | Actinobacteria | *Dermabacter_hominis*_1368 | 89.47 | 109 | 167 | 225 |
| CPL03 | Strong | WP_253254962.1 | Actinobacteria | *Corynebacterium_striatum* | 89.47 | 110 | 168 | 226 |
| CPL04 | Strong | WP_197551992.1 | Actinobacteria | *Trueperella pecoris* | 89.47 | 111 | 169 | 227 |
| CPL05 | Strong | MCI6532281.1 | Actinobacteria | *Bifidobacterium animalis* | 89.47 | 112 | 170 | 228 |
| CPL06 | Strong | WP_291499654.1 | Actinobacteria | *Actinomyces* sp. | 89.47 | 113 | 171 | 229 |
| CPL07 | Strong | WP_134316353.1 | Actinobacteria | *Corynebacterium silvaticum* | 86.84 | 114 | 172 | 230 |
| CPL08 | Strong | MDU7484863.1 | Actinobacteria | *Cutibacterium avidum* | 86.84 | 115 | 173 | 231 |
| CPL09 | Strong | WP_049619209.1 | Actinobacteria | *Actinobaculum suis* | 86.84 | 116 | 174 | 232 |
| CPL10 | Strong | MDD7505539.1 | Actinobacteria | *Actinomycetaceae* bacterium | 84.21 | 117 | 175 | 233 |
| CPL11 | Strong | CRH60380.1 | Chlamydiota | *Chlamydia trachomatis* | 86.84 | 118 | 176 | 234 |
| CPL12 | Strong | MDO5722416.1 | Actinobacteria | *Actinomycetaceae* bacterium | 89.47 | 119 | 177 | 235 |
| CPL13 | Strong | OFQ56130.1 | Actinobacteria | *Corynebacterium* sp. HMSC074H12 | 84.21 | 120 | 178 | 236 |
| CPL14 | Strong | MBS6276004.1 | Actinobacteria | *Actinomycetaceae* bacterium | 81.58 | 121 | 179 | 237 |
| CPL15 | Strong | WP_288336691.1 | Actinobacteria | uncultured *Varibaculum* sp. | 81.58 | 122 | 180 | 238 |
| CPL16 | Strong | WP_165315851.1 | Actinobacteria | *Schaalia* sp. ZJ405 | 81.58 | 123 | 181 | 239 |
| CPL18 | Detectable | WP_323456950.1 | Actinobacteria | *Cutibacterium granulosum* | 81.58 | 124 | 182 | 240 |
| CPL20 | Strong | WP_235810848.1 | Actinobacteria | *Tractidigestivibacter scatoligenes* | 78.95 | 125 | 183 | 24 |
| CPL21 | Strong | WP_236842337.1 | Actinobacteria | *Boudabousia tangfeifanii* | 78.95 | 126 | 184 | 242 |
| CPL22 | Detectable | DAQ44887.1 | Virus | *Caudoviricetes* sp. | 78.95 | 127 | 185 | 243 |
| CPL23 | Detectable | WP_274959455.1 | Actinobacteria | *Thermophilibacter provencensis* | 78.95 | 128 | 186 | 244 |

TABLE 13-continued

CW_7 repeat sequences, source protein, taxonomy and sequence identity to the CLB2-CBD CW_7 repeat.

| Label | Activity Level* | GenBank Acc. # | Phylum | Taxonomy | AA ID %** | Protein SEQ ID | CBD SEQ ID | Chimera SEQ ID |
|---|---|---|---|---|---|---|---|---|
| CPL24 | Strong | WP_277035292.1 | Actinobacteria | Propionimicrobium lymphophilum | 76.32 | 129 | 187 | 245 |
| CPL25 | Strong | WP_330029979.1 | Actinobacteria | Parolsenella sp. | 81.58 | 130 | 188 | 246 |
| CPL26 | Detectable | WP_087201200.1 | Actinobacteria | Collinsella sp. An271 | 81.58 | 131 | 189 | 247 |
| CPL28 | Detectable | MEE8722860.1 | Actinobacteria | Eggerthellaceae bacterium | 76.32 | 132 | 190 | 248 |
| CPL29 | Strong | WP_003841933.1 | Actinobacteria | Bifidobacterium dentium | 78.95 | 133 | 191 | 249 |
| CPL30 | Detectable | RDB69432.1 | Actinobacteria | Eggerthella sinensis | 71.05 | 134 | 192 | 250 |
| CPL31 | Strong | WP_018340121.1 | Actinobacteria | Corynebacterium caspium | 76.32 | 135 | 193 | 251 |
| CPL32 | Strong | MBP3885850.1 | Actinobacteria | Olsenella sp. | 76.32 | 136 | 194 | 252 |
| CPL33 | Strong | WP_288766823.1 | Actinobacteria | uncultured Varibaculum sp. | 73.68 | 137 | 195 | 253 |
| CPL34 | Strong | WP_306718268.1 | Actinobacteria | Actinotignum urinale | 76.32 | 138 | 196 | 254 |
| CPL35 | Strong | MDY5585074.1 | Actinobacteria | Arcanobacterium sp. | 73.68 | 139 | 197 | 255 |
| CPL36 | Strong | DAO39398.1 | Virus | Caudoviricetes sp. | 76.32 | 140 | 198 | 256 |
| CPL38 | Strong | WP_316114142.1 | Actinobacteria | Bifidobacterium scardovii | 73.68 | 141 | 199 | 257 |
| CPL39 | Strong | CAG9066035.1 | Actinobacteria | Bifidobacterium pseudocatenulatum | 68.42 | 142 | 200 | 258 |
| CPL40 | Detectable | MBR4886392.1 | Bacteroidota | Muribaculaceae bacterium | 61.11 | 143 | 201 | 259 |
| CPL43 | Strong | DAH93651.1 | Virus | Caudoviricetes sp. | 73.68 | 144 | 202 | 260 |
| CPL44 | Detectable | YP_009603465.1 | Virus | Arthrobacter phage Gordon | 74.29 | 145 | 203 | 261 |
| CPL45 | Strong | WP_064468301.1 | Firmicute | Lederbergia galactosidilytica | 65.79 | 146 | 204 | 262 |
| CPL46 | Strong | QFP95395.1 | Virus | Arthrobacter phage Makai | 74.29 | 147 | 205 | 263 |
| CPL49 | Strong | HOU67165.1 | Firmicute | Paludibacteraceae bacterium | 76.32 | 148 | 206 | 264 |
| CPL50 | Detectable | HAP28934.1 | Bacteroidota | Porphyromonadaceae bacterium | 63.16 | 149 | 207 | 265 |
| CPL51 | Strong | MBQ0159319.1 | Bacteroidota | Candidatus Colimorpha merdihippi | 65.79 | 150 | 208 | 266 |
| CPL52 | Strong | MDE6928620.1 | Bacteroidota | Muribaculaceae bacterium | 60.53 | 151 | 209 | 267 |
| CPL53 | Strong | CRH88545.1 | Chlamydiota | Chlamydia trachomatis | 64.1 | 152 | 210 | 268 |
| CPL54 | Strong | WP_071705048.1 | Firmicute | Murdochiella vaginalis | 58.54 | 153 | 211 | 269 |
| CPL55 | Strong | WP_212927898.1 | Firmicute | Oceanobacillus sp. J11TS1 | 65.79 | 154 | 212 | 270 |
| CPL56 | Strong | WP_163583485.1 | Firmicute | Gracilibacillus saliphilus | 63.16 | 155 | 213 | 271 |
| CPL59 | Strong | WP_271528891.1 | Firmicute | Enterococcus faecalis | 60.98 | 156 | 214 | 272 |
| CPL60 | Strong | WP_269310727.1 | Firmicute | Peptostreptococcus equinus | 58.54 | 157 | 215 | 273 |
| CPL61 | Strong | MDO4391700.1 | Firmicute | Clostridium sp. | 65.79 | 158 | 216 | 274 |
| CPL62 | Strong | MCI5948801.1 | Firmicute | Oscillospiraceae bacterium | 63.41 | 159 | 217 | 275 |
| CPL63 | Strong | MBD8989282.1 | Firmicute | Clostridiales bacterium | 63.41 | 160 | 218 | 276 |
| CPL64 | Strong | WP_028505417.1 | Firmicute | Ruminococcus sp. FC2018 | 60.98 | 161 | 219 | 277 |
| CPL65 | Strong | MDE6733460.1 | Firmicute | Oscillospiraceae bacterium | 60.98 | 162 | 220 | 278 |
| CPL66 | Strong | WP_288704103.1 | Firmicute | uncultured Catenibacterium sp. | 68.42 | 163 | 221 | 279 |
| CPL68 | Strong | WP_105302716.1 | Firmicute | Anaerolactibacter massiliensis | 65.79 | 164 | 222 | 280 |
| CPL69 | Strong | WP_163104227.1 | Firmicute | Amedibacterium intestinale | 60.98 | 165 | 223 | 281 |

*Activity level for CBD in initial screen in combination with CLC2-EAD.
**Amino acid percent sequence identity of top CW_7 match within the CBD to CLB2-CBD CW_7 repeat sequence.

Figure 24A:
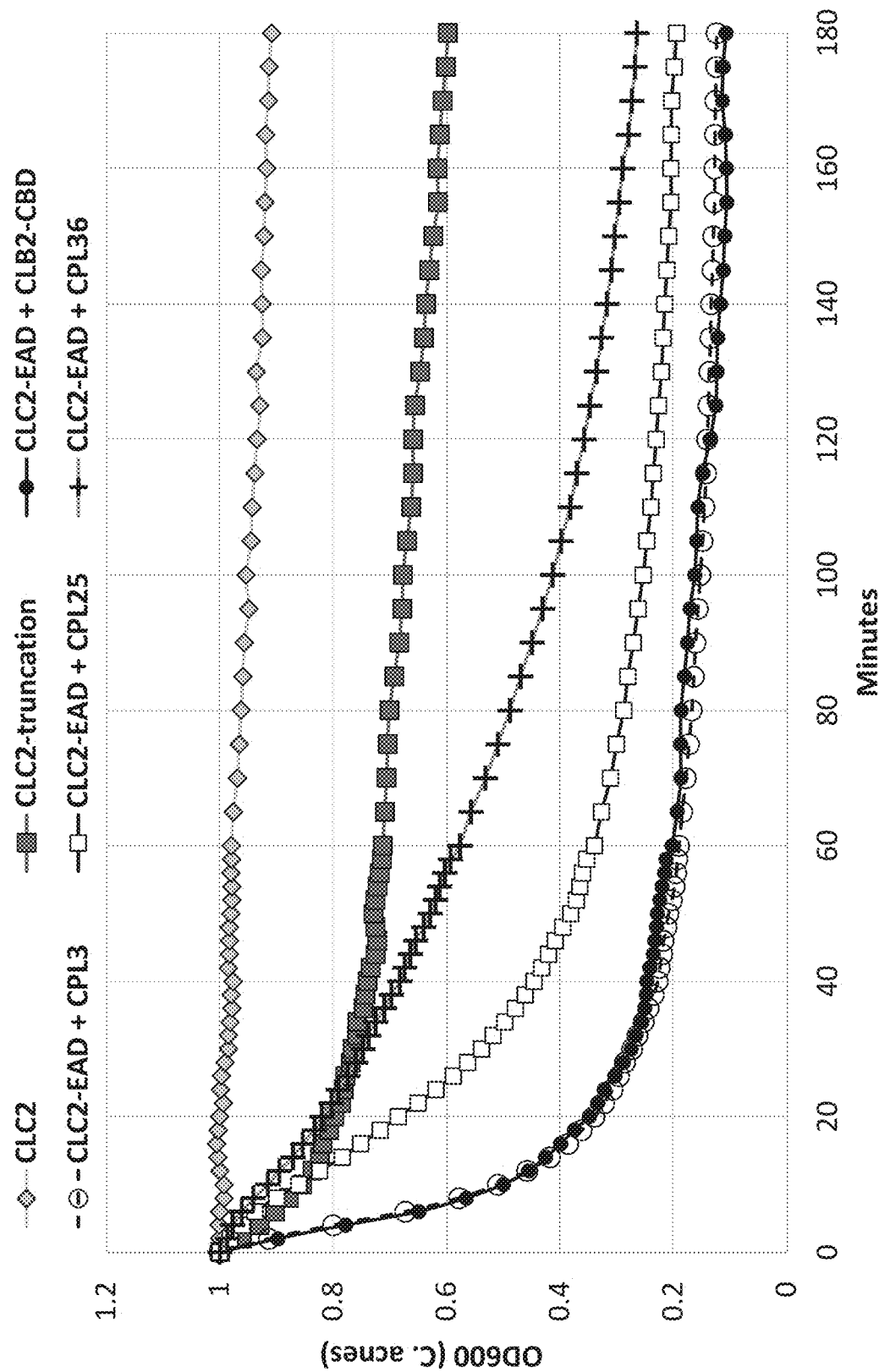
FIG. 24A-24B show the results of turbidity reduction assays for chimeric proteins comprising CPL3, CPL25, and CPL36 CBDs (FIG. 24A) and for chimeric proteins comprising CPL46, CPL54, and CPL66 CBDs (FIG. 24B). For comparison, also shown are the results for full length CLC2, the CLC2-truncation, and the CLC2-EAD+CLB2-CBD chimeric protein.
Figure 24B:
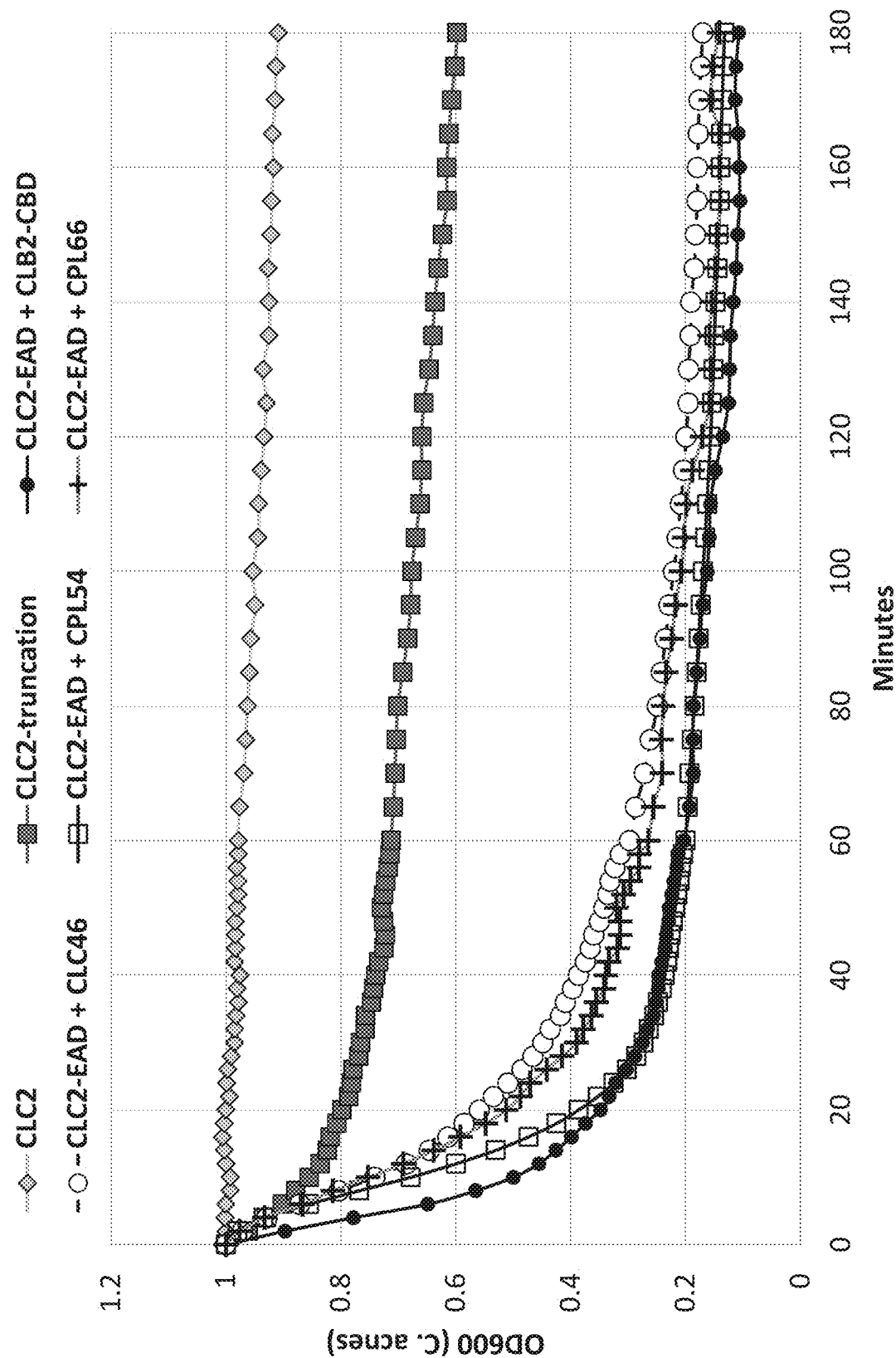

Example 19: Actinobacteria, Viral, and Firmicute CW_7 CBDs Facilitate Binding and Lysis of C. acnes in Chimeric CWHs in Turbidity Reduction Assays From the diverse CW_7-containing CBDs identified in Example 6 and explored in Example 18, six CBDs were selected for protein purification and activity testing, with an emphasis on selecting from a broad diversity of taxonomies and similarity ranges to the CLB2-CBD CW_7 sequence. As such, two candidates were selected from each of Actinobacteria diversity, viral diversity, and Firmicute (also known as "bacillota") diversity. These six CBDs contain two to four CW_7 repeats, with a top CW_7 sequence match ranging from 63%-89% amino acid identity to the CLB2-CBD CW_7 sequence, as listed in Table 14. Chimeric proteins were generated that comprised the CLC2-EAD in combination with each of these CW_7-comprising CBDs. These proteins were expressed in BL21 E. coli cells, purified using the C-terminal 6xHis tag, and assayed for C. acnes lytic activity in a turbidity reduction assay. As controls, the results were compared to full length CLC2 protein, CLC2-truncation, and the CLC2-EAD+CLB2-CBD chimeric protein. As shown in FIG. 24A-24B, all six diverse CW_7 chimeric proteins produced C. acnes lytic activity that was stronger than full length CLC2, as well as the more active CLC2-truncation, indicating that these CW_7 repeat-containing CBDs enhanced the C. acnes lytic activity of the CLC1-family EAD. These data indicate that CW_7 repeat-containing CBDs from diverse organisms can facilitate binding and lysis of C. acnes.

TABLE 14

CW_7 repeat sequences, source protein, taxonomy
and sequence identity to the CLB2-CBD CW_7 repeat.

| Identifier | Accession # | Taxonomic Assignment | CBD SEQ ID NO | AA ID %* |
|---|---|---|---|---|
| CPL03 | WP_253254962.1 | Corynebacterium striatum/Actinobacteria | 168 | 89.474 |
| CPL25 | WP_330029979.1 | Parolsenella sp./Actinobacteria | 188 | 81.579 |
| CPL36 | DAO39398.1 | Caudoviricetes sp./Virus | 198 | 76.316 |
| CPL46 | QFP95395.1 | Arthrobacter_phage_Makai/Virus | 205 | 74.286 |
| CPL54 | WP_071705048.1 | Murdochiella vaginalis/Firmicute | 211 | 63.415 |
| CPL66 | WP_288704103.1 | Catenibacterium sp./Firmicute | 221 | 68.421 |

*Amino acid percent sequence identity of top CW_7 match within the CBD to CLB2-CBD CW_7 repeat sequence.

Example 20: Single CW_7 Repeat Sufficient for Increasing Anti-C. acnes Activity in Chimeric Combination with CLC1-Family EAD The CLB1-CBD contains two CW_7 repeats, CLB1-CW7-1 (SEQ ID NO: 45) and CLB1-CW7-2 (SEQ ID NO: 46), which are 82% identical at the amino acid level. To test whether either single CW_7 repeat is sufficient to improve the activity of the native CLC1 protein, two chimeric proteins were constructed, linking the CLC1-EAD to an individual CW_7 repeat of CLB1: CLC1-EAD+CLB1-CW7-1-CBD (SEQ ID NO: 2942) and CLC1-EAD+CLB1-CW7-2-CBD (SEQ ID NO: 2943). Sequences of these chimeric proteins are shown in Table 15.

TABLE 15

Single CW_7 repeat comprising chimeric enzymes.

| Description | Sequence |
|---|---|
| CLC1-EAD + CLB1-CW7-1-CBD | MTFIQARHHGGNSNTPITRLVIHATCPDVG YPSASKAGRAVSTAEYFASTSRSASAHYVC DVSATVQCLSEETIGYHAPPNSHSIGIEIC ADGGSRASFEKASHAYTREQWLSPQVWPAV ERAAILARGICHRHHIPVRKLTTAQVKSGM SGICGHDNVSDAFHQSDHDDPGPYFPWNEF IAAIQGKNTNKGELSMSDVTSPNIDALADA VIRGEYGNGEERRRRLGANYAAVQKRVNEK LTG (SEQ ID NO: 2942) |
| CLC1-EAD + CLB1-CW7-2-CBD | MTFIQARHHGGNSNTPITRLVIHATCPDVG YPSASKAGRAVSTAEYFASTSRSASAHYVC DVSATVQCLSEETIGYHAPPNSHSIGIEIC ADGGSRASFEKASHAYTREQWLSPQVWPAV ERAAILARGICHRHHIPVRKLTTAQVKSGM SGICGHDNVSDAFHQSDHDDPGPYFPWNEF IAAIQGKNTNKGELSMSDVTSPNIDALADA VIRGDYGNGEERRRRLGNLYDQVQARVNQK LGY (SEQ ID NO: 2943) |

Figure 25:
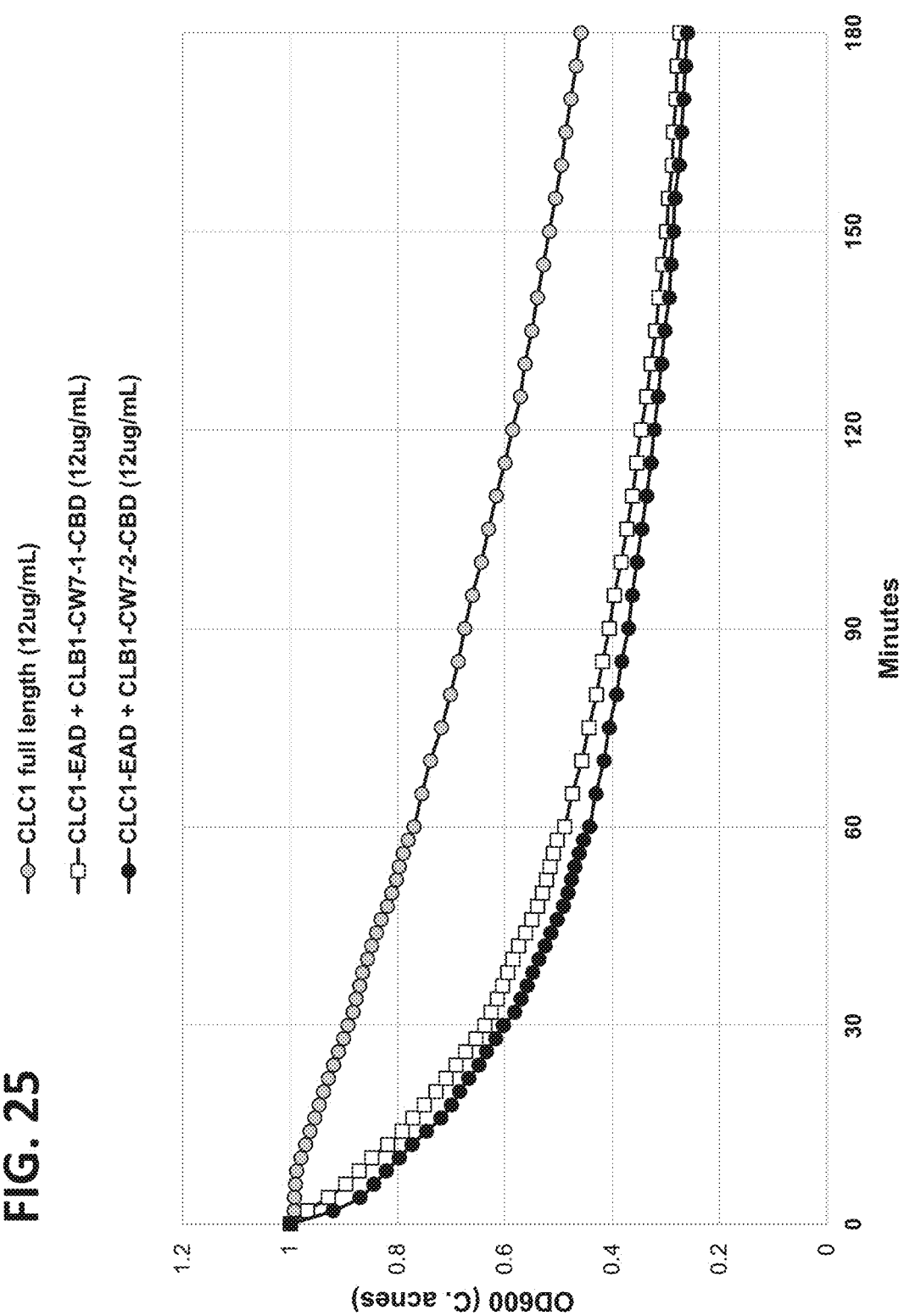
FIG. 25 shows the results of turbidity reduction assays against *C. acnes* for a CLC1-EAD+CLB1-CW7-1 chimera and a CLC1-EAD+CLB1-CW7-2 chimera in comparison to full length CLC1.

These chimeric proteins were expressed and purified, and then tested in turbidity reduction assays against C. acnes. Results are shown in FIG. 25, with the activity of the native full length CLC1 enzyme shown for comparison. In both cases, the chimeric proteins containing a single CW_7 repeat from CLB1-CBD exhibited significantly improved activity compared to the native CLC1 protein, demonstrating that a single CW_7 repeat from a CBD containing multiple CW_7 repeats is sufficient to improve activity of a CLC1-family enzyme.

Figure 26:
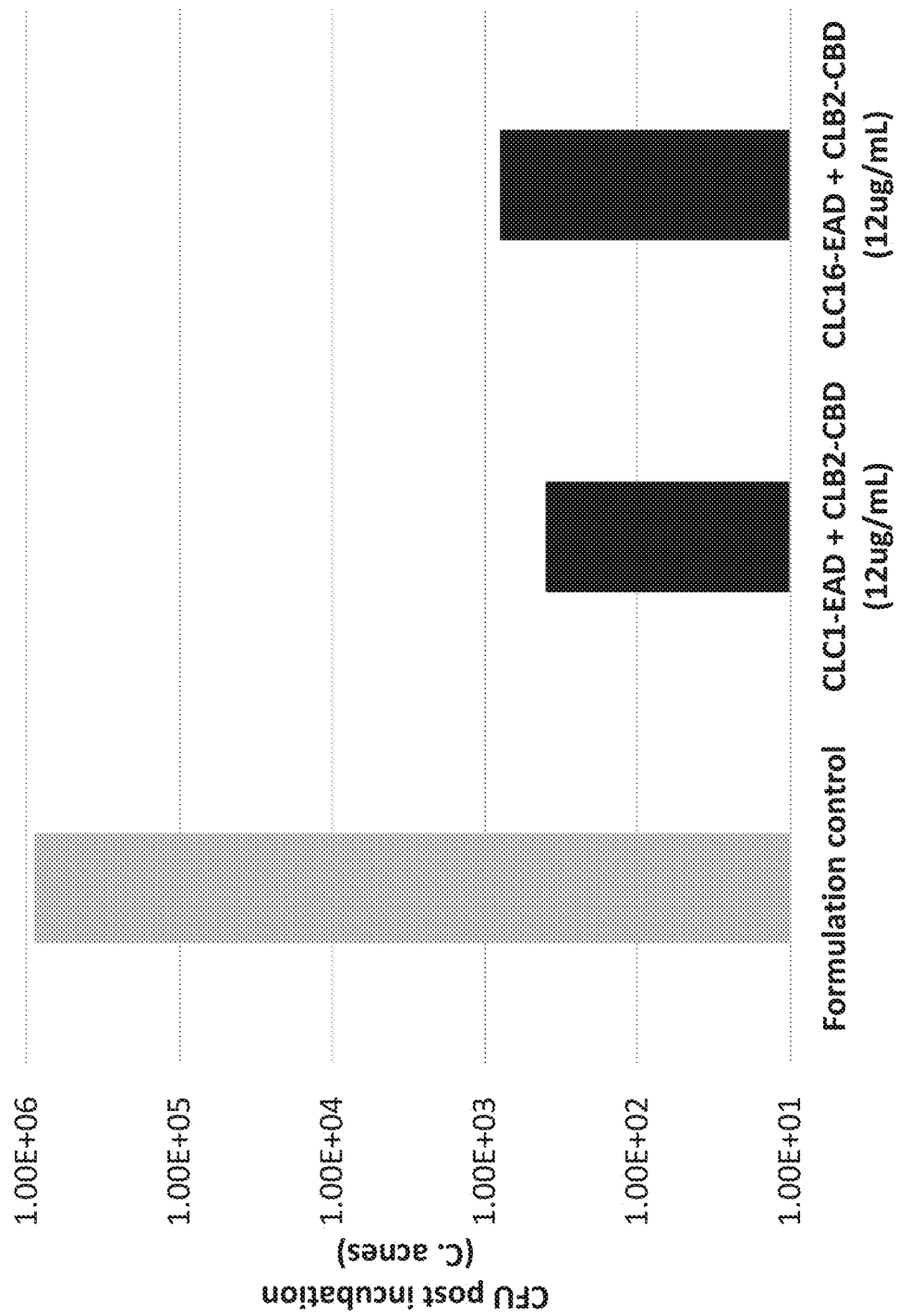
FIG. 26 shows the results of quantitative killing assays against *C. acnes* for HPMC-based hydrogel formulations of CLC1-EAD+CLB2-CBD and CLC16-EAD+CLB2-CBD chimeras, compared to untreated control.

Example 21: Topical Hydrogel Formulations of Chimeric Proteins Retained Strong Lytic Activity Against C. acnes The CLC1-EAD+CLB2-CBD (SEQ ID NO: 53) and CLC16-EAD+CLB2-CBD (SEQ ID NO: 106) chimeric enzymes were formulated in a hydroxypropyl methylcellulose (HPMC)-based hydrogel at a concentration of 12 µg/mL. HPMC is a commonly used ingredient in skin care formulations. These formulations were incubated at room temperature for 7 days and then an aliquot was used in quantitative killing assays of C. acnes. In brief, about $1 \times 10^6$ cells of C. acnes were added to either a hydrogel formulation control (no added enzyme) or hydrogels containing enzyme. The amount of viable C. acnes remaining after 6 hours of incubation were measured via serial dilutions onto BHI plates incubated at 37° C. under anaerobic conditions for 4-5 days. Results are shown in FIG. 26. Formulations containing either enzyme showed a 3-4 order of magnitude reduction in viable C. acnes cells relative to the formulation control, demonstrating that these chimeric enzymes were stable and retained enzymatic activity in topical formulations.

Materials and Methods

Key Materials and Methods used in the Examples are described below:

Phylogenetic Analysis of CLC1 Family Proteins and their Amidase Domains

A multiple sequence alignment of CLC1-CLC19 compared to members of the well-conserved CaLys1 endolysin family found in C. acnes and C. acnes phages was generated using MUSCLE (world wide web at ebi.ac.uk/Tools/msa/muscle/) and visualized as an unrooted tree using standard parameters using the Interactive Tree of Life online tool (world wide web at academic.oup.com/nar/article/49/W1/W293/6246398). Similarly, to analyze specifically the amidase domains, the amino acid sequences encoding the amidase domains in these 100 proteins were delineated using SMART or CDD and a multiple sequence alignment and phylogenetic tree were generated as described above.

Bacterial Strains and Culture Conditions

Cutibacterium acnes (ATCC11827) used in this study was grown at 37° C. with shaking in Brain Heart Infusion (BHI) Broth containing Oxyrase® for Broth to remove dissolved oxygen or on BHI plates containing 2% (w/v) agar placed at 37° C. in a GasPak EZ pouch to generate an anaerobic environment (Becton Dickinson). Corynebacterium xerosis (ATCC 373) and Corynebacterium striatum (ATCC BAA-1293) were grown in BHI Broth at 37° C. Staphylococcus epidermidis (NRLL B4268) was grown in tryptic soy broth (TSB; Difco, Frankling Lakes, NJ) at 37° C. with shaking.

*Escherichia coli* DH10B (Invitrogen, Carlsbad, CA) was used for cloning and storage. *E. coli* BL21 (DE3) (EMD Biosciences, San Diego, CA) was used for protein expression. All *E. coli* strains were grown at 37° C. with shaking in 2×YT medium (16 g/L tryptone, 10 g/L yeast extract, 5 g/L NaCl) or on plates containing LB (10 g/L tryptone, 10 g/L NaCl, 5 g/L yeast extract) supplemented with 2% (w/v) agar. 50 µg/ml kanamycin was used for proper selection of *E. coli* clones.

Construction of Full-Length, Truncated, and Chimeric Cell Wall Hydrolases

Full-length cell wall hydrolases were synthesized with NdeI/HindIII sites and ligated into the NdeI/HindIII sites of pET24a (+). Truncated versions of cell wall hydrolases were amplified from full length wild-type genes with NdeI/HindIII sites and ligated into the NdeI/HindIII sites of pET24a (+). For chimeric enzymes, individual enzymatic domains including up to 50 amino acids upstream and downstream were synthesized with NdeI/SpeI sites. Individual cell wall binding domains including up to 25 amino acids upstream and downstream were synthesized with SpeI/HindIII sites. The chimeric lysins were constructed by ligating both an enzymatic domain and a cell wall binding domain into the NdeI/HindIII sites of pET24a (+).

The expression vectors containing the chimeric cell wall hydrolases were chemically transformed into BL21 *E. coli* for downstream protein expression and purification.

Protein Production and Purification

BL21 cells containing the appropriate expression plasmid were grown in 2×YT media overnight at 37° C. with shaking. The next morning, cells were back diluted 1:1000 in flasks containing 50 mLs of ZYM-5052 autoinduction media (Fisher scientific cat no. NC1093977) and incubated with shaking for 2-3 hrs at 37° C. Flasks were then transferred to 22° C. and incubated with shaking overnight. Cultures were spun down, supernatant was poured off, and pellets were stored at −80° C. for at least 30 minutes. Each frozen pellet was resuspended in 5 mL of lysis buffer (NPI-10 (100 uM Tris pH 8, 300 mM NaCl, 10 mM imidazole) with the addition of 5 mg lysozyme and 100 units of DNAseI) and incubated at 30° C. with gentle shaking for 30 mins. Cells were then spun down until a clear lysate was obtained and a solid pellet formed. The clear lysate was transferred to a column containing Nickel-NTA Agarose Resin (Gold Bio) suspended in NPI-10. Columns were inverted several times to completely resuspend the resin and incubated at 4° C. for a minimum of one hour to allow for protein binding. Once the resin was completely settled, the lysate was allowed to run off the column and the columns were washed with two column volumes of NPI-20 (100 uM Tris pH 8, 300 mM NaCl, 20 mM imidazole). Proteins were then eluted by adding 3 mLs of NPI-250 (100 uM Tris pH 8, 300 mM NaCl, 250 mM imidazole) and fractions were collected. Proteins were quantified and purity checked via Bradford assay and SDS-PAGE gel and Coomassie staining. Proteins were then concentrated and buffer exchanged into protein storage buffer (50 mM Tris pH6.8, 300 mM NaCl) using Amicon Ultra-15 Filter Units. For long term storage, proteins were stored at −80° C. with 30% glycerol.

Clearing Assays

Candidate cell wall hydrolases were tested for lytic activity against *C. acnes* via a clearing assay. *C. acnes* was grown for 4 days on BHI agar plates at 37° C. under anaerobic conditions. Cells were then harvested from the plates and washed 2× in 25 mM HEPES buffer pH 7.3. The washed cells were resuspended in 25 mM HEPES buffer pH 7.3 at 10 ODs/mL. Next, 1 mL of cells was mixed with 20 mL of 0.5% agar and poured into a petri plate. After the agar set, 15 µL of purified protein from the candidate cell wall hydrolases were spotted onto the agar. The plates were incubated at room temperature and checked for clearing around the spots after 24 hours.

Turbidity Reduction Assays

Purified candidate cell wall hydrolases were tested for lytic activity against *C. acnes* via a turbidity reduction assay. *C. acnes* was grown for 4 days on BHI agar plates at 37° C. under anaerobic conditions. Cells were then harvested from the plates and washed 2× in 25 mM HEPES pH 7.3. The OD of the cells was adjusted to an $OD_{600}$~1.0 and mixed with 2-fold dilutions of purified protein (e.g. 12 µg/mL to 0.75 µg/mL) to a final volume of 200 µl of 25 mM HEPES pH 7.3 in a flat bottom microtiter plate. The $OD_{600}$ of each well was then measured every two minutes for 1 hour and then every 5 minutes using a microplate reader. Specific activity was calculated as previously described (Briers et al., J Biochem Biophys Methods. 2007 Apr. 10; 70(3):531-3). To test thermostability of proteins, an aliquot of the protein was incubated for 30 minutes at temperatures ranging from 37° C. to 58° C. Proteins were then immediately tested in turbidity reductions assays as described above. To test the pH range of proteins, turbidity reduction assays were performed using 25 mM Tris HCl pH 8.0, 25 mM HEPES pH 7.3, 25 mM Citrate buffer pH 6.5, 25 mM Citrate buffer pH 6.2, 25 mM Citrate buffer pH 5.7, 25 mM Citrate buffer pH 5.3, 25 mM Citrate buffer pH 4.9, 25 mM Citrate buffer pH 4.5, and 25 mM Citrate buffer pH 4.2.

Quantitative Killing Experiments

The antimicrobial activity of candidate cell wall hydrolases were measured via quantitative killing assays. *C. acnes* was grown for 4 days on BHI agar plates at 37° C. under anaerobic conditions. Cells were then harvested from the plates and washed 2× in 25 mM HEPES pH 7.3. Approximately $1 \times 10^6$ cells per reaction were then mixed with the desired amount of protein in a final volume of 200 µL of 25 mM HEPES pH 7.3 and incubated at room temperature. At the appropriate time points (e.g., 0 time point and the 6 hour time point), 20 µl of the reaction was removed and serial dilutions were plated on BHI agar plates and grown for 4-5 days at 37° C. under anaerobic conditions. CFUs were then counted to calculate the number of viable cells.

REFERENCES

The following references are incorporated herein by reference in their entireties for all purposes.

1. Bickers, D. R. et al. The burden of skin diseases: 2004. *Journal of the American Academy of Dermatology* 55, 490-500 (2006).
2. Gallitano, S. M. & Berson, D. S. How Acne Bumps Cause the Blues: The Influence of Acne Vulgaris on Self-Esteem. *Int J Womens Dermatol* 4, 12-17 (2018).
3. Mias, C., Mengeaud, V., Bessou-Touya, S. & Duplan, H. Recent advances in understanding inflammatory acne: Deciphering the relationship between *Cutibacterium acnes* and Th17 inflammatory pathway. *Acad Dermatol Venereol* 37, 3-11 (2023).
4. Fitz-Gibbon, S. et al. *Propionibacterium acnes* strain populations in the human skin microbiome associated with acne. *J Invest Dermatol* 133, 2152-2160 (2013).
5. Lomholt, H. B., Scholz, C. F. P., Bruggemann, H., Tettelin, H. & Kilian, M. A comparative study of *Cutibacterium (Propionibacterium) acnes* clones from acne patients and healthy controls. *Anaerobe* 47, 57-63 (2017).

6. Zhang, N., Yuan, R., Xin, K. Z., Lu, Z. & Ma, Y. Antimicrobial Susceptibility, Biotypes and Phylotypes of Clinical *Cutibacterium* (Formerly *Propionibacterium*) *acnes* Strains Isolated from Acne Patients: An Observational Study. *Dermatol Ther (Heidelb)* 9, 735-746 (2019).
7. Bruggemann, H., Salar-Vidal, L., Gollnick, H. P. M. & Lood, R. A Janus-Faced Bacterium: Host-Beneficial and -Detrimental Roles of *Cutibacterium acnes. Front Microbiol* 12, 673845 (2021).
8. Zaenglein, A. L. et al. Guidelines of care for the management of acne vulgaris. *Journal of the American Academy of Dermatology* 74, 945-973.e33 (2016).
9. Chien, A. L. et al. Association of Systemic Antibiotic Treatment of Acne With Skin Microbiota Characteristics. *JAMA Dermatol* 155, 425-434 (2019).
10. Patangia, D. V., Anthony Ryan, C., Dempsey, E., Paul Ross, R. & Stanton, C. Impact of antibiotics on the human microbiome and consequences for host health. *Microbiologyopen* 11, e1260 (2022).
11. Antimicrobial Resistance Collaborators. Global burden of bacterial antimicrobial resistance in 2019: a systematic analysis. *Lancet* 399, 629-655 (2022).
12. Dams, D. & Briers, Y. Enzybiotics: Enzyme-Based Antibacterials as Therapeutics. *Adv Exp Med Biol* 1148, 233-253 (2019).
13. Gerstmans, H., Criel, B. & Briers, Y. Synthetic biology of modular endolysins. *Biotechnology Advances* 36, 624-640 (2018).
14. Natarelli, N., Gahoonia, N. & Sivamani, R. K. Bacteriophages and the Microbiome in Dermatology: The Role of the Phageome and a Potential Therapeutic Strategy. *Int J Mol Sci* 24, 2695 (2023).

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as an acknowledgment or any form of suggestion that they constitute valid prior art or form part of the common general knowledge in any country in the world.

NUMBERED EMBODIMENTS OF THE INVENTION

Notwithstanding the appended claims, the disclosure sets forth the following numbered embodiments:

I. Novel Truncated Proteins

1. An enzymatically active, C-terminally truncated recombinant CLC1-family protein.
2. The recombinant protein of embodiment 1, wherein the recombinant protein is truncated in comparison to the corresponding full-length, native CLC1-family protein sequence.
3. The recombinant protein of embodiment 1 or 2, wherein the recombinant protein exhibits increased lytic activity and/or solubility compared to the corresponding full-length, native CLC1-family protein sequence.
4. The recombinant protein of any one of embodiments 1-3, wherein the truncation is a truncation of the conserved C-terminal region of the full-length, native CLC1-family protein sequence.
5. The recombinant protein of any one of embodiments 1-4, wherein the truncation is a truncation of the entire C-terminal region of the CLC1-family protein that follows the enzymatically active domain of the full-length, native CLC1-family protein sequence.
6. The recombinant protein of any one of embodiments 1-5, wherein the truncation is a truncation of residue number 195-205 and all subsequent residues from the full-length, native CLC1-family protein amino acid sequence.
7. The recombinant protein of any one of embodiments 1-6, wherein the truncation is a truncation of about 5, 10, 15, 20, 25, 30, 35, 40, 45, 50, 55, 60, 65, 70, 75, 80, 85, 90, 95, 100, 105, 110, 115, 120, 125, or 130 amino acids from the C-terminus of the full-length, native CLC1-family protein.
8. The recombinant protein of any one of embodiments 1-7, wherein the CLC1-family protein is CLC1 (SEQ ID NO: 1).
9. The recombinant protein of any one of embodiments 1-7, wherein the CLC1-family protein is CLC2 (SEQ ID NO: 2).
10. The recombinant protein of any one of embodiments 1-7, wherein the CLC1-family protein is CLC3 (SEQ ID NO: 3).
11. The recombinant protein of any one of embodiments 1-7, wherein the CLC1-family protein is CLC4 (SEQ ID NO: 4).
12. The recombinant protein of any one of embodiments 1-7, wherein the CLC1-family protein is CLC5 (SEQ ID NO: 5).
13. The recombinant protein of any one of embodiments 1-7, wherein the CLC1-family protein is CLC6 (SEQ ID NO: 6).
14. The recombinant protein of any one of embodiments 1-7, wherein the CLC1-family protein is CLC7 (SEQ ID NO: 7).
15. The recombinant protein of any one of embodiments 1-7, wherein the CLC1-family protein is CLC8 (SEQ ID NO: 8).
16. The recombinant protein of any one of embodiments 1-7, wherein the CLC1-family protein is CLC9 (SEQ ID NO: 9).
17. The recombinant protein of any one of embodiments 1-7, wherein the CLC1-family protein is CLC10 (SEQ ID NO: 10).
18. The recombinant protein of any one of embodiments 1-7, wherein the CLC1-family protein is CLC11 (SEQ ID NO: 11).
19. The recombinant protein of any one of embodiments 1-7, wherein the CLC1-family protein is CLC12 (SEQ ID NO: 12).
20. The recombinant protein of any one of embodiments 1-7, wherein the CLC1-family protein is CLC13 (SEQ ID NO: 13).
21. The recombinant protein of any one of embodiments 1-7, wherein the CLC1-family protein is CLC14 (SEQ ID NO: 14).
22. The recombinant protein of any one of embodiments 1-7, wherein the CLC1-family protein is CLC15 (SEQ ID NO: 15).
23. The recombinant protein of any one of embodiments 1-7, wherein the CLC1-family protein is CLC16 (SEQ ID NO: 16).

24. The recombinant protein of any one of embodiments 1-7, wherein the CLC1-family protein is CLC17 (SEQ ID NO: 17).

25. The recombinant protein of any one of embodiments 1-7, wherein the CLC1-family protein is CLC18 (SEQ ID NO: 18).

26. The recombinant protein of any one of embodiments 1-7, wherein the CLC1-family protein is CLC19 (SEQ ID NO: 19).

27. The recombinant protein of any one of embodiments 1-7, wherein the CLC1-family protein is CLC1, CLC2, CLC3, CLC4, CLC5, CLC6, CLC7, CLC8, CLC9, CLC10, CLC11, CLC12, CLC13, CLC14, CLC16, CLC18, or CLC19, and wherein the C-terminal truncation is a truncation of about 70-90 amino acids compared to the full-length, native CLC1-family protein sequence.

28. The recombinant protein of any one of embodiments 1-7, wherein the CLC1-family protein is CLC1, CLC2, CLC3, CLC4, CLC5, CLC6, CLC7, CLC8, CLC9, CLC10, CLC11, CLC12, CLC13, CLC14, CLC16, CLC18, or CLC19, and wherein the C-terminal truncation is a truncation of about 80, 81, or 82 amino acids compared to the full-length, native CLC1-family protein sequence.

29. The recombinant protein of any one of embodiments 1-7, wherein the CLC1-family protein is CLC15, and wherein the C-terminal truncation is a truncation of about 115-135 amino acids compared to the full-length, native CLC1-family protein sequence.

30. The recombinant protein of any one of embodiments 1-7, wherein the CLC1-family protein is CLC15, and wherein the C-terminal truncation is a truncation of about 123 amino acids compared to the full-length, native CLC1-family protein sequence.

31. The recombinant protein of any one of embodiments 1-7, wherein the CLC1-family protein is CLC17, and wherein the C-terminal truncation is a truncation of about 55-75 amino acids compared to the full-length, native CLC1-family protein sequence.

32. The recombinant protein of any one of embodiments 1-7, wherein the CLC1-family protein is CLC17, and wherein the C-terminal truncation is a truncation of about 66 amino acids compared to the full-length, native CLC1-family protein sequence.

33. The recombinant protein of any one of embodiments 1-32, wherein the recombinant protein comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 75-93.

34. The recombinant protein of any one of embodiments 1-33, wherein the recombinant protein comprises an amino acid sequence selected from the group consisting of SEQ ID NO: 75-93.

35. The recombinant protein of any one of embodiments 1-34, wherein the recombinant protein comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 20-36.

36. The recombinant protein of any one of embodiments 1-35, wherein the recombinant protein comprises an amino acid sequence selected from the group consisting of SEQ ID NO: 20-36.

37. An enzymatically active, C-terminally truncated recombinant CLC16 protein.

38. The recombinant protein of embodiment 37, wherein the C-terminal truncation is a truncation of about 5, 10, 15, 20, 25, 30, 35, 40, 45, 50, 55, 60, 65, 70, 75, 80, 85, 90, 95, 100, 105, or 110 amino acids compared to the full-length, native CLC16 protein sequence (SEQ ID NO: 16).

39. The recombinant protein of embodiment 37 or 38, wherein the C-terminal truncation is a truncation of about 81 amino acids compared to the full-length, native CLC16 protein sequence (SEQ ID NO: 16).

40. The recombinant protein of any one of embodiments 37-39, wherein the truncation is a truncation from residue number 195-210 to residue number 282 of the full-length, native CLC16 protein amino acid sequence (SEQ ID NO: 16).

41. The recombinant protein of any one of embodiments 37-40, wherein the recombinant protein comprises the amino acid sequence of SEQ ID NO: 90.

42. The recombinant protein of any one of embodiments 37-41, wherein the recombinant protein comprises the amino acid sequence of SEQ ID NO: 35.

43. The recombinant protein of any one of embodiments 37-42, wherein the recombinant protein exhibits increased lytic activity and/or solubility compared to full-length, native CLC16.

44. An enzymatically active, C-terminally truncated recombinant CLC2 protein.

45. The recombinant protein of embodiment 44, wherein the C-terminal truncation is a truncation of about 5, 10, 15, 20, 25, 30, 35, 40, 45, 50, 55, 60, 65, 70, 75, 80, 85, 90, 95, 100, 105, or 110 amino acids compared to the full-length, native CLC2 protein sequence (SEQ ID NO: 2).

46. The recombinant protein of embodiment 44 or 45, wherein the C-terminal truncation is a truncation of about 82 amino acids compared to the full-length, native CLC2 protein sequence (SEQ ID NO: 2).

47. The recombinant protein of any one of embodiments 44-46, wherein the truncation is a truncation from residue number 195-210 to residue number 282 of the full-length, native CLC2 protein amino acid sequence (SEQ ID NO: 2).

48. The recombinant protein of any one of embodiments 44-47, wherein the recombinant protein comprises the amino acid sequence of SEQ ID NO: 76.

49. The recombinant protein of any one of embodiments 44-48, wherein the recombinant protein comprises the amino acid sequence of SEQ ID NO: 21.

50. The recombinant protein of any one of embodiments 44-49, wherein the recombinant protein exhibits increased lytic activity and/or solubility compared to full-length, native CLC2.

51. A recombinant protein comprising a sequence having at least 40, 45, 50, 55, 60, 65, 70, 75, 80, 85, 90, 95, 96, 97, 98, or 99% sequence identity to an amino acid sequence selected from the group consisting of SEQ ID NO: 75-93.

52. A recombinant protein comprising a sequence having at least 40, 45, 50, 55, 60, 65, 70, 75, 80, 85, 90, 95, 96, 97, 98, or 99% sequence identity to an amino acid sequence selected from the group consisting of SEQ ID NO: 20-36.

53. The recombinant protein of any one of embodiments 1-52, wherein the recombinant protein exhibits increased anti-*Cutibacterium acnes* lytic activity compared to a corresponding full-length native CLC1-family protein.

54. The recombinant protein of any one of embodiments 1-53, wherein the recombinant protein has improved solubility compared to a corresponding full-length native CLC1-family protein.
55. An enzymatically active, C-terminally truncated recombinant CaLys1-family protein.
56. The recombinant protein of embodiment 55, wherein the recombinant protein is truncated in comparison to the corresponding full-length, native CaLys1-family protein sequence.
57. The recombinant protein of embodiment 55 or 56, wherein the truncation is a truncation of the conserved C-terminal region of the full-length, native CaLys1-family protein sequence.
58. The recombinant protein of any one of embodiments 55-57, wherein the truncation is a truncation of the entire C-terminal region of the CaLys1-family protein that follows the enzymatically active domain of the full-length, native CaLys1-family protein sequence.
59. The recombinant protein of any one of embodiments 55-58, wherein the truncation is a truncation of residue number 195-205 and all subsequent residues from the full-length, native CaLys1-family protein amino acid sequence.
60. The recombinant protein of any one of embodiments 55-59, wherein the truncation is a truncation of about 5, 10, 15, 20, 25, 30, 35, 40, 45, 50, 55, 60, 65, 70, 75, 80, 85, 90, 95, 100, 105, 110, 115, 120, 125, or 130 amino acids from the C-terminus of the full-length, native CaLys1-family protein.
61. The recombinant protein of any one of embodiments 55-60, wherein the CaLys1-family protein is CaLys1 (SEQ ID NO: 72).
62. The recombinant protein of any one of embodiments 55-61, wherein the CaLys1-family protein is CaLys1, and wherein the C-terminal truncation is a truncation of about 70-90 amino acids compared to full-length, native CaLys1 sequence.
63. The recombinant protein of any one of embodiments 55-62, wherein the CaLys1-family protein is CaLys1, and wherein the C-terminal truncation is a truncation of about 83 amino acids compared to the full-length, native CaLys1 sequence.
64. The recombinant protein of any one of embodiments 55-63, wherein the recombinant protein comprises an amino acid sequence having at least 40, 45, 50, 55, 60, 65, 70, 75, 80, 85, 90, 95, 96, 97, 98, or 99% sequence identity to SEQ ID NO: 74.
65. The recombinant protein of any one of embodiments 55-64, wherein the recombinant protein comprises the amino acid sequence of SEQ ID NO: 74.
66. The recombinant protein of any one of embodiments 55-65, wherein the recombinant protein comprises an amino acid sequence having at least 40, 45, 50, 55, 60, 65, 70, 75, 80, 85, 90, 95, 96, 97, 98, or 99% sequence identity to SEQ ID NO: 73.
67. The recombinant protein of any one of embodiments 55-66, wherein the recombinant protein comprises the amino acid sequence of SEQ ID NO: 73.
68. A recombinant protein comprising an amino acid sequence having at least 40, 45, 50, 55, 60, 65, 70, 75, 80, 85, 90, 95, 96, 97, 98, or 99% sequence identity to SEQ ID NO: 74.
69. A recombinant protein comprising the amino acid sequence of SEQ ID NO: 74.
70. A recombinant protein comprising an amino acid sequence having at least 40, 45, 50, 55, 60, 65, 70, 75, 80, 85, 90, 95, 96, 97, 98, or 99% sequence identity to SEQ ID NO: 73.
71. A recombinant protein comprising the amino acid sequence of SEQ ID NO: 73.
72. The recombinant protein of any one of embodiments 1-71, wherein the recombinant protein is enzymatically active against *Cutibacterium acnes*.
73. The recombinant protein of any one of embodiments 55-72, wherein the recombinant protein has higher anti-*Cutibacterium acnes* lytic activity compared to the corresponding native, full-length CaLys1-family protein sequence.
74. The recombinant protein of any one of embodiments 1-73, wherein the recombinant protein has higher anti-*Cutibacterium acnes* lytic activity than full-length, native CaLys1.
75. The recombinant protein of any one of embodiments 55-74, wherein the recombinant protein has improved solubility compared to the corresponding native, full-length CaLys1-family protein sequence.
76. The recombinant protein of any one of embodiments 1-75, wherein the recombinant protein has improved solubility compared to native, full-length CaLys1.

II. Novel EAD Embodiments

1. A recombinant protein comprising a CLC1-family enzymatically active domain (EAD).
2. The recombinant protein of embodiment 1, wherein the EAD is derived from CLC1, CLC2, CLC3, CLC4, CLC5, CLC6, CLC7, CLC8, CLC9, CLC10, CLC11, CLC12, CLC13, CLC14, CLC15, CLC16, CLC17, CLC18, or CLC19.
3. The recombinant protein of embodiment 1 or 2, wherein the EAD is derived from SEQ ID NO: 1-19.
4. The recombinant protein of any one of embodiments 1-3, wherein the EAD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 20-36.
5. A recombinant protein comprising an enzymatically active domain (EAD) having at least 40, 45, 50, 55, 60, 65, 70, 75, 80, 85, 90, 95, 96, 97, 98, or 99% sequence identity to an amino acid sequence selected from the group consisting of SEQ ID NO: 20-36.
6. The recombinant protein of any one of embodiments 1-5, wherein the EAD comprises an amino acid sequence selected from the group consisting of SEQ ID NO: 20-36.
7. The recombinant protein of any one of embodiments 1-6, wherein the EAD comprises an amino acid sequence having at least 40, 45, 50, 55, 60, 65, 70, 75, 80, 85, 90, 95, 96, 97, 98, or 99% sequence identity to SEQ ID NO: 35.
8. The recombinant protein of any one of embodiments 1-6, wherein the EAD comprises the amino acid sequence of SEQ ID NO: 35.
9. The recombinant protein of any one of embodiments 1-6, wherein the EAD comprises an amino acid sequence having at least 40, 45, 50, 55, 60, 65, 70, 75, 80, 85, 90, 95, 96, 97, 98, or 99% sequence identity to SEQ ID NO: 21.

10. The recombinant protein of any one of embodiments 1-6, wherein the EAD comprises the amino acid sequence of SEQ ID NO: 21.
11. The recombinant protein of any one of embodiments 1-10, wherein the recombinant protein exhibits lytic activity against *Cutibacterium acnes*.
12. The recombinant protein of any one of embodiments 1-11, wherein the recombinant protein exhibits lytic activity against *Cutibacterium acnes* of a phylotype selected from the list consisting of: IA1, IA2, IB, II, and III.
13. The recombinant protein of any one of embodiments 1-12, wherein the recombinant protein exhibits lytic activity against phylotypes IA1, IA2, IB, and II of *Cutibacterium acnes*.
14. The recombinant protein of any one of embodiments 1-13, wherein the recombinant protein exhibits improved solubility and/or anti-*Cutibacterium acnes* activity compared to native CaLys1 (SEQ ID NO: 72).
14.1 The recombinant protein of any one of embodiments 1-14, wherein the recombinant protein comprises the CLC1-family EAD motif (SEQ ID NO: 2939).
15. The recombinant protein of any one of embodiments 1-14.1, wherein the recombinant protein comprises a heterologous cell wall binding domain (CBD).
16. The recombinant protein of embodiment 15, wherein the CBD comprises a CW_7 repeat with at least 40, 45, 50, 55, 60, 65, 70, 75, 80, 85, 90, 95, 96, 97, 98, or 99% sequence identity to SEQ ID NO: 47.
17. The recombinant protein of embodiment 15 or 16, wherein the CBD comprises a CW_7 repeat having the amino acid sequence of SEQ ID NO: 47.
18. The recombinant protein of any one of embodiments 15-17, wherein the CBD comprises a CW_7 repeat with at least 40, 45, 50, 55, 60, 65, 70, 75, 80, 85, 90, 95, 96, 97, 98, or 99% sequence identity to an amino acid sequence selected from the group consisting of SEQ ID NO: 45-51.
19. The recombinant protein of any one of embodiments 15-18, wherein the CBD comprises a CW_7 repeat having an amino acid sequence selected from the group consisting of SEQ ID NO: 45-51.
20. The recombinant protein of any one of embodiments 15-19, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 166-223.
21. The recombinant protein of any one of embodiments 15-20, wherein the CBD comprises a CW_7 repeat comprised by an amino acid sequence selected from the group consisting of SEQ ID NO: 166-223.
22. The recombinant protein of any one of embodiments 15-21, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 168, 188, 198, 205, 211, and 221.
23. The recombinant protein of any one of embodiments 15-22, wherein the CBD comprises a CW_7 repeat comprised by an amino acid sequence selected from the group consisting of SEQ ID NO: 168, 188, 198, 205, 211, and 221.
24. The recombinant protein of any one of embodiments 15-23, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 282-2938.
25. The recombinant protein of any one of embodiments 15-24, wherein the CBD comprises a CW_7 repeat comprised by an amino acid sequence selected from the group consisting of SEQ ID NO: 282-2938.
26. The recombinant protein of any one of embodiments 15-25, wherein the CBD comprises a CW_7 repeat with at least 40, 45, 50, 55, 60, 65, 70, 75, 80, 85, 90, 95, 96, 97, 98, or 99% sequence identity to a CW_7 comprised by a protein listed in Table 7.
27. The recombinant protein of any one of embodiments 15-26, wherein the CBD comprises a CW_7 repeat comprised by a protein listed in Table 7.
28. The recombinant protein of any one of embodiments 15-27, wherein the CBD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 41-44.
29. The recombinant protein of any one of embodiments 15-27, wherein the CBD comprises an amino acid sequence selected from the group consisting of SEQ ID NO: 41-44.
30. The recombinant protein of any one of embodiments 15-27, wherein the CBD comprises an amino acid sequence having at least 40, 45, 50, 55, 60, 65, 70, 75, 80, 85, 90, 95, 96, 97, 98, or 99% sequence identity to SEQ ID NO: 42.
31. The recombinant protein of any one of embodiments 15-27, wherein the CBD comprises the amino acid sequence of SEQ ID NO: 42.
32. The recombinant protein of any one of embodiments 15-27, wherein the CBD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 166-223.
33. The recombinant protein of any one of embodiments 15-27, wherein the CBD comprises an amino acid sequence selected from the group consisting of SEQ ID NO: 166-223.
34. The recombinant protein of any one of embodiments 15-27, wherein the CBD comprises an amino acid sequence having at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 168, 188, 198, 205, 211, and 221.
35. The recombinant protein of any one of embodiments 15-27, wherein the CBD comprises an amino acid sequence selected from the group consisting of SEQ ID NO: 168, 188, 198, 205, 211, and 221.
36. The recombinant protein of any one of embodiments 15-27, wherein the recombinant protein comprises a CBD having at least 40, 45, 50, 55, 60, 65, 70, 75, 80, 85, 90, 95, 96, 97, 98, or 99% sequence identity to a CBD comprised by an amino acid sequence selected from the group consisting of SEQ ID NO: 282-2938.
37. The recombinant protein of any one of embodiments 15-27, wherein the recombinant protein comprises a CBD comprised by an amino acid sequence selected from the group consisting of SEQ ID NO: 282-2938.
38. The recombinant protein of any one of embodiments 15-27, wherein the recombinant protein comprises a CBD with at least 40, 45, 50, 55, 60, 65, 70, 75, 80, 85, 90, 95, 96, 97, 98, or 99% sequence identity to a CBD comprised by a protein listed in Table 7.

39. The recombinant protein of any one of embodiments 15-27, wherein the recombinant protein comprises a CBD comprised by a protein listed in Table 7.

40. The recombinant protein of any one of embodiments 15-39, wherein the CBD comprises 1, 2, 3, 4, 5, 6, 7, 8, 9, or 10 CW_7 repeats.

41. The recombinant protein of any one of embodiments 1-40, wherein the recombinant protein is a chimeric cell wall hydrolase (CWH).

42. The recombinant protein of any one of embodiments 1-41, wherein the recombinant protein binds to *Cutibacterium acnes*.

43. The recombinant protein of any one of embodiments 1-42, wherein the recombinant protein has lytic activity against *Cutibacterium acnes*.

44. The recombinant protein of any one of embodiments 1-43, wherein the recombinant protein comprises a cell wall binding domain (CBD), and wherein the CBD is located at the C-terminal end of the EAD.

45. The recombinant protein of any one of embodiments 1-44, wherein the recombinant protein displays a higher lytic activity against *C. acnes* than native CaLys1 (SEQ ID NO: 72).

46. The recombinant protein of any one of embodiments 1-45, wherein the recombinant protein displays a higher lytic activity against *C. acnes* than the native protein from which the EAD is derived.

47. The recombinant protein of any one of embodiments 1-46, wherein the recombinant protein displays minimal or no lytic activity against *Corynebacterium xerosis, Corynebacterium striatum*, and/or *Staphylococcus epidermidis*.

48. The recombinant protein of any one of embodiments 1-47, wherein the recombinant protein has lytic activity against *Cutibacterium acnes*, and wherein the lytic activity is measured using a turbidity reduction assay.

49. The recombinant protein of any one of embodiments 1-48, wherein the recombinant protein has lytic activity against *Cutibacterium acnes* across a pH range of 4.2-8.0.

50. The recombinant protein of any one of embodiments 1-49, wherein the recombinant protein has peak *C. acnes* lytic activity at a pH that is less than 7.

51. The recombinant protein of any one of embodiments 1-50, wherein the recombinant protein has peak *C. acnes* lytic activity at a pH of 5.5-6.5, 5.8-6.2, 5.9-6.1, or about 6.0.

52. The recombinant protein of any one of embodiments 1-51, wherein the recombinant protein retains at least 50% of its activity at 25° C. after being exposed to a temperature of up to 45° C., 50° C., 55° C., or 58° C. for 30 minutes.

53. The recombinant protein of any one of embodiments 1-52, wherein the recombinant protein comprises the CLC16 EAD (SEQ ID NO: 35) and retains at least 50% of its activity at 25° C. after being exposed to a temperature of up to 75° C. for 30 minutes.

54. The recombinant protein of any one of embodiments 1-53, wherein the recombinant protein comprises the CLC16 EAD (SEQ ID NO: 35) and retains at least 40% of its activity at 25° C. after being exposed to a temperature of up to 90° C. for 30 minutes.

55. The recombinant protein of any one of embodiments 1-54, wherein the solubility of the recombinant protein is at least 2-fold, at least 5-fold, at least 10-fold, or at least 100-fold higher than the solubility of CaLys1 (SEQ ID NO: 72).

III. Novel CBD Embodiments

1. A recombinant protein comprising a CW_7 cell wall binding domain (CBD).
2. The recombinant protein of embodiment 1, wherein the CBD comprises a CW_7 repeat with at least 40, 45, 50, 55, 60, 65, 70, 75, 80, 85, 90, 95, 96, 97, 98, or 99% sequence identity to SEQ ID NO: 47.
3. The recombinant protein of embodiment 1 or 2, wherein the CBD comprises a CW_7 repeat having the amino acid sequence of SEQ ID NO: 47.
4. The recombinant protein of any one of embodiments 1-3, wherein the CBD comprises a CW_7 repeat with at least 40, 45, 50, 55, 60, 65, 70, 75, 80, 85, 90, 95, 96, 97, 98, or 99% sequence identity to an amino acid sequence selected from the group consisting of SEQ ID NO: 45-51.
5. The recombinant protein of any one of embodiments 1-4, wherein the CBD comprises a CW_7 repeat having an amino acid sequence selected from the group consisting of SEQ ID NO: 45-51.
6. The recombinant protein of any one of embodiments 1-5, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 166-223.
7. The recombinant protein of any one of embodiments 1-6, wherein the CBD comprises a CW_7 repeat comprised by an amino acid sequence selected from the group consisting of SEQ ID NO: 166-223.
8. The recombinant protein of any one of embodiments 1-7, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 168, 188, 198, 205, 211, and 221.
9. The recombinant protein of any one of embodiments 1-8, wherein the CBD comprises a CW_7 repeat comprised by an amino acid sequence selected from the group consisting of SEQ ID NO: 168, 188, 198, 205, 211, and 221.
10. The recombinant protein of any one of embodiments 1-9, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 282-2938.
11. The recombinant protein of any one of embodiments 1-10, wherein the CBD comprises a CW_7 repeat comprised by an amino acid sequence selected from the group consisting of SEQ ID NO: 282-2938.
12. The recombinant protein of any one of embodiments 1-11, wherein the CBD comprises a CW_7 repeat with at least 40, 45, 50, 55, 60, 65, 70, 75, 80, 85, 90, 95, 96, 97, 98, or 99% sequence identity to a CW_7 comprised by a protein listed in Table 7.
13. The recombinant protein of any one of embodiments 1-12, wherein the CBD comprises a CW_7 repeat comprised by a protein listed in Table 7.
14. The recombinant protein of any one of embodiments 1-13, wherein the CBD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 41-44.
15. The recombinant protein of any one of embodiments 1-13, wherein the CBD comprises an amino acid sequence selected from the group consisting of SEQ ID NO: 41-44.
16. The recombinant protein of any one of embodiments 1-13, wherein the CBD comprises an amino acid sequence having at least 40, 45, 50, 55, 60, 65, 70, 75, 80, 85, 90, 95, 96, 97, 98, or 99% sequence identity to SEQ ID NO: 42.
17. The recombinant protein of any one of embodiments 1-13, wherein the CBD comprises the amino acid sequence of SEQ ID NO: 42.
18. The recombinant protein of any one of embodiments 1-13, wherein the CBD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 166-223.
19. The recombinant protein of any one of embodiments 1-13, wherein the CBD comprises an amino acid sequence selected from the group consisting of SEQ ID NO: 166-223.
20. The recombinant protein of any one of embodiments 1-13, wherein the CBD comprises an amino acid sequence having at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 168, 188, 198, 205, 211, and 221.
21. The recombinant protein of any one of embodiments 1-13, wherein the CBD comprises an amino acid sequence selected from the group consisting of SEQ ID NO: 168, 188, 198, 205, 211, and 221.
22. The recombinant protein of any one of embodiments 1-13, wherein the recombinant protein comprises a CBD having at least 40, 45, 50, 55, 60, 65, 70, 75, 80, 85, 90, 95, 96, 97, 98, or 99% sequence identity to a CBD comprised by an amino acid sequence selected from the group consisting of SEQ ID NO: 282-2938.
23. The recombinant protein of any one of embodiments 1-13, wherein the recombinant protein comprises a CBD comprised by an amino acid sequence selected from the group consisting of SEQ ID NO: 282-2938.
24. The recombinant protein of any one of embodiments 1-13, wherein the recombinant protein comprises a CBD with at least 40, 45, 50, 55, 60, 65, 70, 75, 80, 85, 90, 95, 96, 97, 98, or 99% sequence identity to a CBD comprised by a protein listed in Table 7.
25. The recombinant protein of any one of embodiments 1-13, wherein the recombinant protein comprises a CBD comprised by a protein listed in Table 7.
26. The recombinant protein of any one of embodiments 1-25, wherein the CBD comprises 1, 2, 3, 4, 5, 6, 7, 8, 9, or 10 CW_7 repeats.
27. The recombinant protein of any one of embodiments 1-26, wherein the recombinant protein is an enzyme.
28. The recombinant protein of any one of embodiments 1-27, wherein the recombinant protein is a chimeric protein.
29. The recombinant protein of any one of embodiments 1-28, wherein the recombinant protein is a chimeric cell wall hydrolase (CWH).
29.1 The recombinant protein of any one of embodiments 1-29, wherein the recombinant protein comprises the CW_7-21 motif (SEQ ID NO: 2940).
29.2 The recombinant protein of any one of embodiments 1-29.1, wherein the recombinant protein comprises the CW_7-19 motif (SEQ ID NO: 2941).
30. The recombinant protein of any one of embodiments 1-29.2, wherein the recombinant protein comprises an enzymatically active domain (EAD).
31. The recombinant protein of embodiment 30, wherein the EAD is heterologous to the CBD.
32. The recombinant protein of embodiment 30 or 31, wherein the EAD has at least 40, 45, 50, 55, 60, 65, 70, 75, 80, 85, 90, 95, 96, 97, 98, or 99% sequence identity to a CaLys1-family EAD.
33. The recombinant protein of any one of embodiments 30-32, wherein the EAD comprises a CaLys1-family EAD.
34. The recombinant protein of any one of embodiments 30-33, wherein the EAD has at least 40, 45, 50, 55, 60, 65, 70, 75, 80, 85, 90, 95, 96, 97, 98, or 99% sequence identity to SEQ ID NO: 73.
35. The recombinant protein of any one of embodiments 30-34, wherein the EAD comprises the amino acid sequence of SEQ ID NO: 73.
36. The recombinant protein of any one of embodiments 30-31, wherein the EAD has at least 40, 45, 50, 55, 60, 65, 70, 75, 80, 85, 90, 95, 96, 97, 98, or 99% sequence identity to a CLC1-family EAD.
37. The recombinant protein of any one of embodiments 30-31 and 36, wherein the EAD comprises a CLC1-family EAD.
38. The recombinant protein of any one of embodiments 30-31 and 36-37, wherein the EAD has at least 40, 45, 50, 55, 60, 65, 70, 75, 80, 85, 90, 95, 96, 97, 98, or 99% sequence identity to an amino acid sequence selected from the list consisting of SEQ ID NO: 20-36.
39. The recombinant protein of any one of embodiments 30-31 and 36-38, wherein the EAD comprises an amino acid sequence selected from the list consisting of SEQ ID NO: 20-36.
40. The recombinant protein of any one of embodiments 30-31 and 36-39, wherein the EAD has at least 40, 45, 50, 55, 60, 65, 70, 75, 80, 85, 90, 95, 96, 97, 98, or 99% sequence identity to SEQ ID NO: 21.
41. The recombinant protein of any one of embodiments 30-31 and 36-40, wherein the EAD comprises the amino acid sequence of SEQ ID NO: 21.
42. The recombinant protein of any one of embodiments 30-31 and 36-39, wherein the EAD has at least 40, 45, 50, 55, 60, 65, 70, 75, 80, 85, 90, 95, 96, 97, 98, or 99% sequence identity to SEQ ID NO: 35.
43. The recombinant protein of any one of embodiments 30-31 and 36-39, wherein the EAD comprises the amino acid sequence of SEQ ID NO: 35.
44. The recombinant protein of any one of embodiments 1-43, wherein the recombinant protein binds to *Cutibacterium acnes*.
45. The recombinant protein of any one of embodiments 1-44, wherein the recombinant protein has lytic activity against *Cutibacterium acnes*.
46. The recombinant protein of any one of embodiments 1-45, wherein the recombinant protein comprises an enzymatically active domain (EAD), and wherein the CBD is located at the C-terminal end of the EAD.
47. The recombinant protein of any one of embodiments 1-46, wherein the recombinant protein displays a higher lytic activity against *C. acnes* than the native protein from which the CW_7 and/or CBD is derived.
48. The recombinant protein of any one of embodiments 1-47, wherein the recombinant protein displays minimal or no lytic activity against *Corynebacterium xerosis, Corynebacterium striatum*, and/or *Staphylococcus epidermidis*.
49. The recombinant protein of any one of embodiments 1-48, wherein the recombinant protein has lytic activity against *Cutibacterium acnes*, and wherein the lytic activity is measured using a turbidity reduction assay.
50. The recombinant protein of any one of embodiments 1-49, wherein the recombinant protein has lytic activity against *Cutibacterium acnes* across a pH range of 4.2-8.0.
51. The recombinant protein of any one of embodiments 1-50, wherein the recombinant protein has peak *C. acnes* lytic activity at a pH that is less than 7.
52. The recombinant protein of any one of embodiments 1-51, wherein the recombinant protein has peak *C. acnes* lytic activity at a pH of 5.5-6.5, 5.8-6.2, 5.9-6.1, or about 6.0.
53. The recombinant protein of any one of embodiments 1-52, wherein the recombinant protein retains at least 50% of its activity at 25° C. after being exposed to a temperature of up to 45° C., 50° C., 55° C., or 58° C. for 30 minutes.
54. The recombinant protein of any one of embodiments 1-53, wherein the solubility of the recombinant protein is at least 2-fold, at least 5-fold, at least 10-fold, or at least 100-fold higher than the solubility of native CaLys1 (SEQ ID NO: 72).

IV. Novel Chimeric Cell Wall Hydrolase Embodiments

1. A chimeric cell wall hydrolase (CWH) comprising:
a) a CW_7 cell wall binding domain (CBD), and
b) a CLC1-family enzymatically active domain (EAD).
2. The chimeric CWH of embodiment 1, wherein the EAD is derived from CLC1, CLC2, CLC3, CLC4, CLC5, CLC6, CLC7, CLC8, CLC9, CLC10, CLC11, CLC12, CLC13, CLC14, CLC15, CLC16, CLC17, CLC18, or CLC19.
3. The chimeric CWH of embodiment 1 or embodiment 2, wherein the EAD is derived from SEQ ID NO: 1-19.
4. The chimeric CWH of any one of embodiments 1-3, wherein the EAD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 20-36.
5. The chimeric CWH of any one of embodiments 1-4, wherein the EAD comprises an amino acid sequence selected from the group consisting of SEQ ID NO: 20-36.
6. The chimeric CWH of any one of embodiments 1-5, wherein the EAD comprises an amino acid sequence having at least 40, 45, 50, 55, 60, 65, 70, 75, 80, 85, 90, 95, 96, 97, 98, or 99% sequence identity to SEQ ID NO: 35.
7. The chimeric CWH of any one of embodiments 1-5, wherein the EAD comprises the amino acid sequence of SEQ ID NO: 35.
8. The chimeric CWH of any one of embodiments 1-5, wherein the EAD comprises an amino acid sequence having at least 40, 45, 50, 55, 60, 65, 70, 75, 80, 85, 90, 95, 96, 97, 98, or 99% sequence identity to SEQ ID NO: 21.
9. The chimeric CWH of any one of embodiments 1-5, wherein the EAD comprises the amino acid sequence of SEQ ID NO: 21.
10. A chimeric cell wall hydrolase (CWH) comprising:
a) a CW_7 cell wall binding domain (CBD), and
b) the enzymatically active domain (EAD) from CLC16 (SEQ ID NO: 35).
11. A chimeric cell wall hydrolase (CWH) comprising:
a) a CW_7 cell wall binding domain (CBD), and
b) the enzymatically active domain (EAD) from CLC2 (SEQ ID NO: 21).
12. A chimeric cell wall hydrolase (CWH) comprising:
a) a CW_7 cell wall binding domain (CBD), and
b) a CaLys1-family enzymatically active domain (EAD).
13. The chimeric CWH of embodiment 12, wherein the EAD has at least 40, 45, 50, 55, 60, 65, 70, 75, 80, 85, 90, 95, 96, 97, 98, or 99% sequence identity to SEQ ID NO: 73.
14. The chimeric CWH of embodiment 12 or 13, wherein the EAD comprises the amino acid sequence of SEQ ID NO: 73.
14.1 A chimeric cell wall hydrolase (CWH) comprising:
a) a CW_7 cell wall binding domain (CBD), and
b) the PlyGVE2 enzymatically active domain (EAD) (SEQ ID NO: 64) or the CD27L EAD (SEQ ID NO: 63).
15. A chimeric cell wall hydrolase (CWH) comprising:
a) a CW_7 cell wall binding domain (CBD), and
b) the enzymatically active domain (EAD) from CaLys1 (SEQ ID NO: 73).
16. The chimeric CWH of any one of embodiments 1-15, wherein the CBD comprises a CW_7 repeat with at least 40, 45, 50, 55, 60, 65, 70, 75, 80, 85, 90, 95, 96, 97, 98, or 99% sequence identity to SEQ ID NO: 47.
17. The chimeric CWH of any one of embodiments 1-16, wherein the CBD comprises a CW_7 repeat having the amino acid sequence of SEQ ID NO: 47.
18. The chimeric CWH of any one of embodiments 1-17, wherein the CBD comprises a CW_7 repeat with at least 40, 45, 50, 55, 60, 65, 70, 75, 80, 85, 90, 95, 96, 97, 98, or 99% sequence identity to an amino acid sequence selected from the group consisting of SEQ ID NO: 45-51.
19. The chimeric CWH of any one of embodiments 1-18, wherein the CBD comprises a CW_7 repeat having an amino acid sequence selected from the group consisting of SEQ ID NO: 45-51.
20. The chimeric CWH of any one of embodiments 1-19, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 166-223.
21. The chimeric CWH of any one of embodiments 1-20, wherein the CBD comprises a CW_7 repeat comprised by an amino acid sequence selected from the group consisting of SEQ ID NO: 166-223.
22. The chimeric CWH of any one of embodiments 1-21, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 168, 188, 198, 205, 211, and 221.

23. The chimeric CWH of any one of embodiments 1-22, wherein the CBD comprises a CW_7 repeat comprised by an amino acid sequence selected from the group consisting of SEQ ID NO: 168, 188, 198, 205, 211, and 221.

24. The chimeric CWH of any one of embodiments 1-23, wherein the CBD comprises a CW_7 repeat with at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 282-2938.

25. The chimeric CWH of any one of embodiments 1-24, wherein the CBD comprises a CW_7 repeat comprised by an amino acid sequence selected from the group consisting of SEQ ID NO: 282-2938.

26. The chimeric CWH of any one of embodiments 1-25, wherein the CBD comprises a CW_7 repeat with at least 40, 45, 50, 55, 60, 65, 70, 75, 80, 85, 90, 95, 96, 97, 98, or 99% sequence identity to a CW_7 comprised by a protein listed in Table 7.

27. The chimeric CWH of any one of embodiments 1-26, wherein the CBD comprises a CW_7 repeat comprised by a protein listed in Table 7.

28. The chimeric CWH of any one of embodiments 1-27, wherein the CBD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 41-44.

29. The chimeric CWH of any one of embodiments 1-27, wherein the CBD comprises an amino acid sequence selected from the group consisting of SEQ ID NO: 41-44.

30. The chimeric CWH of any one of embodiments 1-27, wherein the CBD comprises an amino acid sequence having at least 40, 45, 50, 55, 60, 65, 70, 75, 80, 85, 90, 95, 96, 97, 98, or 99% sequence identity to SEQ ID NO: 42.

31. The chimeric CWH of any one of embodiments 1-27, wherein the CBD comprises the amino acid sequence of SEQ ID NO: 42.

32. The chimeric CWH of any one of embodiments 1-27, wherein the CBD comprises an amino acid sequence having at least 40, 45, 50, 55, 60, 65, 70, 75, 80, 85, 90, 95, 96, 97, 98, or 99% sequence identity to an amino acid sequence selected from the group consisting of SEQ ID NO: 166-223.

33. The chimeric CWH of any one of embodiments 1-27, wherein the CBD comprises an amino acid sequence selected from the group consisting of SEQ ID NO: 166-223.

34. The chimeric CWH of any one of embodiments 1-27, wherein the CBD comprises an amino acid sequence having at least 40, 45, 50, 55, 60, 65, 70, 75, 80, 85, 90, 95, 96, 97, 98, or 99% sequence identity to a CW_7 repeat comprised by an amino acid sequence selected from the group consisting of SEQ ID NO: 168, 188, 198, 205, 211, and 221.

35. The chimeric CWH of any one of embodiments 1-27, wherein the CBD comprises an amino acid sequence selected from the group consisting of SEQ ID NO: 168, 188, 198, 205, 211, and 221.

36. The chimeric CWH of any one of embodiments 1-27, wherein the recombinant protein comprises a CBD having at least 40, 45, 50, 55, 60, 65, 70, 75, 80, 85, 90, 95, 96, 97, 98, or 99% sequence identity to a CBD comprised by an amino acid sequence selected from the group consisting of SEQ ID NO: 282-2938.

37. The chimeric CWH of any one of embodiments 1-27, wherein the recombinant protein comprises a CBD comprised by an amino acid sequence selected from the group consisting of SEQ ID NO: 282-2938.

38. The chimeric CWH of any one of embodiments 1-27, wherein the recombinant protein comprises a CBD with at least 40, 45, 50, 55, 60, 65, 70, 75, 80, 85, 90, 95, 96, 97, 98, or 99% sequence identity to a CBD comprised by a protein listed in Table 7.

39. The chimeric CWH of any one of embodiments 1-27, wherein the recombinant protein comprises a CBD comprised by a protein listed in Table 7.

40. The chimeric CWH of any one of embodiments 1-39, wherein the CBD comprises 1, 2, 3, 4, 5, 6, 7, 8, 9, or 10 CW_7 repeats.

41. A chimeric cell wall hydrolase (CWH) comprising:
    a) the cell wall binding domain (CBD) from CLB2 (SEQ ID NO: 42), and
    b) the enzymatically active domain (EAD) from CLC16 (SEQ ID NO: 35).

42. A chimeric cell wall hydrolase (CWH) comprising an amino acid sequence having at least 70, 75, 80, 85, 90, 95, 96, 97, 98, or 99% sequence identity with SEQ ID NO: 106.

43. A chimeric cell wall hydrolase (CWH) comprising the amino acid sequence of SEQ ID NO: 106.

44. A chimeric cell wall hydrolase (CWH) comprising:
    a) the cell wall binding domain (CBD) from CLB2 (SEQ ID NO: 42), and
    b) the enzymatically active domain (EAD) from CLC2 (SEQ ID NO: 21).

45. A chimeric cell wall hydrolase (CWH) comprising an amino acid sequence having at least 70, 75, 80, 85, 90, 95, 96, 97, 98, or 99% sequence identity with SEQ ID NO: 57.

46. A chimeric cell wall hydrolase (CWH) comprising the amino acid sequence of SEQ ID NO: 57.

47. A chimeric cell wall hydrolase (CWH) comprising an amino acid sequence having at least 70, 75, 80, 85, 90, 95, 96, 97, 98, or 99% sequence identity with an amino acid sequence selected from the list consisting of SEQ ID NO: 52-59.

48. A chimeric cell wall hydrolase (CWH) comprising an amino acid sequence selected from the list consisting of SEQ ID NO: 52-59.

49. A chimeric cell wall hydrolase (CWH) comprising an amino acid sequence having at least 70, 75, 80, 85, 90, 95, 96, 97, 98, or 99% sequence identity with an amino acid sequence selected from the list consisting of SEQ ID NO: 53, 57, 59, and 94-107.

50. A chimeric cell wall hydrolase (CWH) comprising an amino acid sequence selected from the list consisting of SEQ ID NO: 52-59.

51. A chimeric cell wall hydrolase (CWH) comprising an amino acid sequence having at least 70, 75, 80, 85, 90, 95, 96, 97, 98, or 99% sequence identity with an amino acid sequence selected from the list consisting of SEQ ID NO: 224-281.

52. A chimeric cell wall hydrolase (CWH) comprising an amino acid sequence selected from the list consisting of SEQ ID NO: 224-281.

53. A chimeric cell wall hydrolase (CWH) comprising an amino acid sequence having at least 70, 75, 80, 85, 90, 95, 96, 97, 98, or 99% sequence identity with an amino acid sequence selected from the list consisting of SEQ ID NO: 66-69.

54. A chimeric cell wall hydrolase (CWH) comprising an amino acid sequence selected from the list consisting of SEQ ID NO: 66-69.

55. The chimeric CWH of any one of embodiments 1-54, wherein the chimeric CWH binds to *Cutibacterium acnes*.

56. The chimeric CWH of any one of embodiments 1-55, wherein the chimeric CWH exhibits lytic activity against *Cutibacterium acnes*.

57. The chimeric CWH of any one of embodiments 1-56, wherein the chimeric CWH exhibits lytic activity against *Cutibacterium acnes* of a phylotype selected from the list consisting of: IA1, IA2, IB, II, and III.

58. The chimeric CWH of any one of embodiments 1-57, wherein the chimeric CWH exhibits lytic activity against phylotypes IA1 and IA2 of *Cutibacterium acnes*.

59. The chimeric CWH of any one of embodiments 1-58 wherein the chimeric CWH exhibits lytic activity against phylotypes IA1, IA2, IB, and II of *Cutibacterium acnes*.

60. The chimeric CWH of any one of embodiments 1-59, wherein the chimeric CWH exhibits improved anti-*Cutibacterium acnes* activity compared to native CaLys1 (SEQ ID NO: 72).

61. The chimeric CWH of any one of embodiments 1-60, wherein the CBD is located at the C-terminal end of the EAD.

62. The chimeric CWH of any one of embodiments 1-61, wherein the chimeric CWH displays a higher lytic activity against *C. acnes* than the native protein from which the CBD is derived.

63. The chimeric CWH of any one of embodiments 1-62, wherein the chimeric CWH displays a higher lytic activity against *C. acnes* than the native protein from which the EAD is derived.

64. The chimeric CWH of any one of embodiments 1-63, wherein the chimeric CWH displays minimal or no lytic activity against *Corynebacterium xerosis*, *Corynebacterium striatum*, and/or *Staphylococcus epidermidis*.

65. The chimeric CWH of any one of embodiments 1-64, wherein the chimeric CWH has lytic activity against *Cutibacterium acnes*, and wherein the lytic activity is measured using a turbidity reduction assay.

66. The chimeric CWH of any one of embodiments 1-65, wherein the chimeric CWH has lytic activity against *Cutibacterium acnes* across a pH range of 4.2-8.0.

67. The chimeric CWH of any one of embodiments 1-66, wherein the chimeric CWH has peak *C. acnes* lytic activity at a pH that is less than 7.

68. The chimeric CWH of any one of embodiments 1-67, wherein the chimeric CWH has peak *C. acnes* lytic activity at a pH of 5.5-6.5, 5.8-6.2, 5.9-6.1, or about 6.0.

69. The chimeric CWH of any one of embodiments 1-68, wherein the chimeric CWH retains at least 50% of its activity at 25° C. after being exposed to a temperature of up to 45° C., 50° C., 55° C., or 58° C. for 30 minutes.

70. The chimeric CWH of any one of embodiments 1-69, wherein the chimeric CWH comprises the CLC16 EAD (SEQ ID NO: 35), or an EAD having an amino acid sequence having at least 70, 75, 80, 85, 90, 95, 96, 97, 98, or 99% sequence identity thereto, and wherein the chimeric CWH retains at least 50% of its activity at 25° C. after being exposed to a temperature of up to 75° C. for 30 minutes.

71. The chimeric CWH of any one of embodiments 1-70, wherein the chimeric CWH comprises the CLC16 EAD (SEQ ID NO: 35), or an EAD having an amino acid sequence having at least 70, 75, 80, 85, 90, 95, 96, 97, 98, or 99% sequence identity thereto, and wherein the chimeric CWH retains at least 40% of its activity at 25° C. after being exposed to a temperature of up to 90° C. for 30 minutes.

72. The chimeric CWH of any one of embodiments 1-71, wherein the chimeric CWH exhibits improved solubility compared to native CaLys1 (SEQ ID NO: 72).

73. The chimeric CWH of any one of embodiments 1-72, wherein the solubility of the chimeric CWH is at least 2-fold, at least 5-fold, at least 10-fold, or at least 100-fold higher than the solubility of native CaLys1 (SEQ ID NO: 72).

V. Novel Formulation & Method Embodiments

1. A formulation comprising a recombinant protein or a chimeric CWH of any of the foregoing embodiments.
2. A formulation comprising a chimeric cell wall hydrolase (CWH) comprising:
   a) a cell wall binding domain (CBD) having at least 40, 45, 50, 55, 60, 65, 70, 75, 80, 85, 90, 95, 96, 97, 98, or 99% sequence identity to the CBD from CLB2 (SEQ ID NO: 42), and
   b) an enzymatically active domain (EAD) having at least 40, 45, 50, 55, 60, 65, 70, 75, 80, 85, 90, 95, 96, 97, 98, or 99% sequence identity to the EAD from CLC16 (SEQ ID NO: 35).
3. A formulation comprising a chimeric cell wall hydrolase (CWH) comprising:
   a) the cell wall binding domain (CBD) from CLB2 (SEQ ID NO: 42), and
   b) the enzymatically active domain (EAD) from CLC16 (SEQ ID NO: 35).
4. A formulation comprising a chimeric CWH comprising an amino acid sequence having at least 80, 81, 82, 83, 84, 85, 86, 87, 88, 89, 90, 91, 92, 93, 94, 95, 96, 97, 98, or 99% identity with SEQ ID NO: 106.
5. A formulation comprising a chimeric CWH comprising the amino acid sequence of SEQ ID NO: 106.
6. The formulation of any one of embodiments 1-5, wherein the formulation is a topical formulation.
7. The formulation of any one of embodiments 1-6, wherein the formulation is a hydrogel, lotion, cream, gel-cream, colloidal patch, or microneedle patch.
8. The formulation of any one of embodiments 1-7, wherein the formulation is a hydrogel.
9. The formulation of any one of embodiments 1-8, wherein the formulation comprises a humectant.
10. The formulation of any one of embodiments 1-9, wherein the formulation comprises a humectant, and wherein the humectant is selected from the list consisting of: aloe vera, betaine, butylene glycol, caprylyl glycol, dimethicone, fructose, glucomannan, glucose, glycerin, glyceryl glucoside, honey, hyaluronic acid, lactic acid, panthenol, polyethylene glycol, propylene glycol, propanediol, sodium hyaluronate, sodium lactate, sodium pyrrolidone carboxylic acid, sorbitol, and urea.

11. The formulation of any one of embodiments 1-10, wherein the formulation comprises 0.1-50% w/v humectant.
12. The formulation of any one of embodiments 1-11, wherein the formulation comprises 0.5-10% w/v humectant.
13. The formulation of any one of embodiments 1-12, wherein the formulation comprises a cellulose polymer.
14. The formulation of any one of embodiments 1-13, wherein the formulation comprises a cellulose polymer, and wherein the cellulose polymer is selected from the list consisting of: hydroxyethyl cellulose, methylcellulose, hydroxy methylcellulose, carboxymethyl cellulose, microcrystalline cellulose, ethyl cellulose, sodium carboxymethyl cellulose, hydroxypropyl cellulose, and cellulose acetate.
15. The formulation of any one of embodiments 1-14, wherein the formulation comprises 0.5-10% w/v of a cellulose polymer.
16. The formulation of any one of embodiments 1-15, wherein the formulation comprises 1-5% w/v of a cellulose polymer.
17. The formulation of any one of embodiments 1-16, wherein the formulation comprises a salt.
18. The formulation of any one of embodiments 1-17, wherein the formulation comprises a salt, and wherein the salt is selected from the list consisting of calcium chloride, Dead Sea salt, Epsom salt, Himalayan pink salt, magnesium chloride, sea salt, and sodium chloride.
19. The formulation of any one of embodiments 1-18, wherein the formulation comprises 10-500 mM of a salt.
20. The formulation of any one of embodiments 1-19, wherein the formulation comprises 50-250 mM of a salt.
21. The formulation of any one of embodiments 1-20, wherein the formulation comprises a buffer.
22. The formulation of any one of embodiments 1-21, wherein the formulation comprises a buffer, and wherein the buffer is selected from the list consisting of: 4-(2-hydroxyethyl)-1-piperazineethanesulfonic acid, acetic acid, ammonium acetate, boric acid, citric acid, glycine, phosphoric acid, potassium hydroxide, potassium phosphate, sodium acetate, sodium bicarbonate, sodium borate, sodium carbonate, sodium citrate, sodium dihydrogen phosphate, sodium hydrogen phosphate, sodium hydroxide, sodium phosphate, sodium tetraborate, tris(hydroxymethyl)aminomethane, and trisodium phosphate.
23. The formulation of any one of embodiments 1-22, wherein the formulation comprises 5-50 mM of a buffer.
24. The formulation of any one of embodiments 1-23, wherein the formulation comprises a surfactant.
25. The formulation of any one of embodiments 1-24, wherein the formulation comprises a surfactant, and wherein the surfactant is selected from the list consisting of: ceteareth-20, cocamidopropyl betaine, cocoglucoside, decyl glucoside, decyl polyglucose, disodium laureth sulfosuccinate, glycereth-26, lauryl glucoside, lauryl polyglucose, sodium cocoyl glutamate, sodium cocoyl isethionate, sodium laureth sulfate, and sodium lauryl sulfate.
26. The formulation of any one of embodiments 1-25, wherein the formulation comprises 0.1-20% w/v of a surfactant.
27. The formulation of any one of embodiments 1-26, wherein the formulation comprises 1-10% w/v of a surfactant.
28. The formulation of any one of embodiments 1-27, wherein the formulation comprises a free amino acid.
29. The formulation of any one of embodiments 1-28, wherein the formulation comprises a free amino acid, and wherein the free amino acid is selected from the list consisting of: alanine, arginine, cysteine, glutamine, glycine, histidine, lysine, methionine, proline, serine, and threonine.
30. The formulation of any one of embodiments 1-29, wherein the formulation comprises 10-250 mM of a free amino acid.
31. The formulation of any one of embodiments 1-30, wherein the formulation comprises an oil.
32. The formulation of any one of embodiments 1-31, wherein the formulation comprises an oil, and wherein the oil is selected from the list consisting of: argan oil, avocado oil, baobab oil, camellia oil, carrot seed oil, coconut oil, evening primrose oil, grapeseed oil, hemp seed oil, jojoba oil, macadamia nut oil, marula oil, mineral oil, olive oil, pomegranate seed oil, raspberry seed oil, rosehip seed oil, squalane oil, sunflower seed oil, sweet almond oil, and tamanu oil.
33. The formulation of any one of embodiments 1-32, wherein the formulation comprises 0.1-20% w/v of an oil.
34. The formulation of any one of embodiments 1-33, wherein the formulation comprises an alcohol.
35. The formulation of any one of embodiments 1-34, wherein the formulation comprises an alcohol, and wherein the alcohol is selected from the list consisting of: cetyl alcohol, ethyl alcohol, isopropyl alcohol, and stearyl alcohol.
36. The formulation of any one of embodiments 1-35, wherein the formulation comprises 0.1-20% w/v of an alcohol.
37. The formulation of any one of embodiments 1-36, wherein the formulation comprises 1-10% w/v of an alcohol.
38. The formulation of any one of embodiments 1-37, wherein the formulation comprises glycerol.
39. The formulation of any one of embodiments 1-38, wherein the formulation comprises 0.5-50% w/v glycerol, 1-30% w/v glycerol, or 1-5% w/v glycerol.
40. The formulation of any one of embodiments 1-39, wherein the formulation comprises petrolatum
41. The formulation of any one of embodiments 1-40, wherein the formulation comprises 0.1-20% w/v petrolatum.
42. The formulation of any one of embodiments 1-41, wherein the formulation is thermostable at 45° C. or 50° C. for at least four weeks or for at least two months.
43. The formulation of any one of embodiments 1-42, wherein the formulation is active within a pH range of 6-8, optionally within a pH range of 5-8.
44. A method of treating a condition associated with *Cutibacterium acnes* (*C. acnes*), the method comprising: administering a composition comprising a recombinant protein or chimeric CWH of any one of the foregoing embodiments.
45. A method of treating a condition associated with *Cutibacterium acnes* (*C. acnes*), the method comprising: administering a formulation according to any one of embodiments 1-43.

46. The method of embodiment 44 or embodiment 45, wherein the condition is Acne vulgaris (acne).

47. The method of any one of embodiments 44-46, wherein the condition is C. acnes infection.

48. A method of restoring the phylotype diversity of Cutibacterium acnes (C. acnes), the method comprising: administering a composition comprising a recombinant protein or chimeric CWH of any one of the foregoing embodiments.

49. A method of restoring the phylotype diversity of Cutibacterium acnes (C. acnes), the method comprising: administering a formulation according to any one of embodiments 1-43.

50. The method of any one of embodiments 44-49, wherein the condition is associated with an over-abundance of C. acnes phylotype IA1 and/or IA2.

51. The method of any one of embodiments 44-50, wherein the method decreases the relative abundances of C. acnes phylotype IA1 and/or IA2.

52. The method of any one of embodiments 44-51, wherein the composition or formulation is administered topically, enterally, or parenterally.

53. The method of any one of embodiments 44-52, wherein the composition or formulation is administered topically.

54. The method of any one of embodiments 44-53, wherein the method further comprises administering an antibiotic.

55. The method of any one of embodiments 44-54, wherein the method reduces the number and/or size of acne lesions.

56. The method of any one of embodiments 44-55, wherein the method reduces skin redness and/or pain.

57. The method of any one of embodiments 44-56, wherein the method reduces C. acnes abundance.

58. A method of identifying a novel CW_7 cell wall binding domain for use in binding, targeting and/or lysing Cutibacterium acnes, the method comprising the steps of:
   a) Searching a genetic database with a known CW_7 query sequence;
   b) Identifying sequences exceeding an amino acid sequence identity cutoff to the query sequence;
   c) Cloning the CW_7 sequence, or the CW_7-comprising CBD sequence, into a chimeric cell wall hydrolase in combination with an enzymatically active domain (EAD) to form a CW_7 chimera; and
   d) Assaying the CW_7 chimera for binding, targeting, and/or lytic activity against Cutibacterium acnes.

59. The method of embodiment 58, wherein the CW_7 query sequence is:
   a) a CW_7 sequence disclosed herein;
   b) a CW_7 sequence disclosed in Table 7; or
   c) a CW_7 sequence from CLB1-4.

60. The method of embodiment 58, wherein the CW_7 query sequence is the CW_7 sequence from CLB2.

61. The method of any one of embodiments 58-60, wherein the EAD is:
   a) An EAD disclosed herein;
   b) An EAD from Table 2; or
   c) An EAD from Table 4.

62. The method of any one of embodiments 58-61, wherein the cutoff is any number selected from the range of 30-99%.

63. The method of any one of embodiments 58-62, wherein the cutoff is 40%.

SEQUENCE LISTING (2943 sequences)

SEQ ID NO: 1 - protein, 281 aa, unidentified
  REGION 1..281: note = Cutibacterium avidum TM16
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVNTLTKLIKASNDQLHYDIGVVQTQNGTLKSKIENLSWVKNPVTGKKWSTKDALWSVWYYVLECRNRIQAIENRLSEIERKAK

SEQ ID NO: 2 - protein, 282 aa, unidentified
  REGION 1..282: note = Cutibacterium granulosum DSM 20700
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDVNTLTKLIKASNDQLHYDIGVVQTQNGNIKKKIDNLSWVKNPVTGKKWSTKDALWSVWYYVLECRNRIQAIENRIYDLEKKVK

SEQ ID NO: 3 - protein, 281 aa, unidentified
  REGION 1..281: note = Cutibacterium avidum
MTFIQARHHGGNSNAPITRLVIHATCPDVGYPSASKAGRAVSTANYFATTDRPASAHYVCDIATTVQCLSEETIGYHAPPNSHSIGIEICADGGSHASFEKASHAYTRDQWLSDDVWPAVERAAILARDICQRHRIPVRKLSTAQVKAGLSGICGHDNVSGAFHQSDHDDPGPYFPWDQFMALVQGKPATPGDLTMADISKLTDAIKASNRQLHHDIGVVQTQNGKLREQIERITWVKNPVTGKKWRITDALWSIWHYVLECRTRIQRLDARLSEVEKKVK

SEQ ID NO: 4 - protein, 281 aa, unidentified
  REGION 1..281: note = Caudoviricetes sp.
MTFIQARHHGGNSNAPITRLVIHATCPDVGYPSASKAGRAVSTAEYFASTSRSASAHYVCDIAATVQCLSEEAIGFHAPPNSHSIGIEICADGGSRASFEKASHAYTREQWLSPQVWPAVERAAILARDICRRHHIPVRKLTTAQVKSGMSGICGHDNVSDAFHQSDHDDPGPYFPWNEFIAAVQGKNTNKGELSMSDVNTLTKLIKASNDQLHYDIGVVQTQNGTLKSKIENLSWVKNPATGKKWSTKDALWSVWYYVLECRNRIMGIENRLSEVEKKVK

SEQ ID NO: 5 - protein, 281 aa, unidentified
  REGION 1..281: note = Cutibacterium avidum
MTFIQARHHGGNSNTPVTRLVIHATCPDVGYPSASKAGRAVSTAEYFASTSRSASAHYVCDVSATVQCLSEEAIGYHAPPNSHSIGIEICADGGSHASFETASHAYTREQWLSPQVWPAVERAAILARDICHRHHIPVRKLTTAQVKSGMSGICGHDNVSDAFRQSDHDDPGPYFPWNEFIAAVQGKTTNKGELSMSDVNTLTKLIKASNDQLHHDIGVVQTQNGTLKSKIDNLSWVKNPVTGKKWSTKDALWSVWYYVLECRNRIQAIENRLPEVEKKVK

SEQ ID NO: 6 - protein, 281 aa, unidentified
  REGION 1..281: note = Cutibacterium avidum
MTFIQARHHGGNSNNPVTRLVIHATCPDVGYPSASKAGRAVSTAQYFASTSRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGPYFPWNEFIAAVQGKNTNKGELSMSDVNTLTKLIKASNDQLHYDIGVVQTQNGTLKSKIENLSWVKNPVTGKKWSTKDALWSVWYYVLECRNRIQAIENRLSEIERKAK

SEQ ID NO: 7 - protein, 281 aa, unidentified
  REGION 1..281: note = Cutibacterium avidum
MTFIQARHHGGNSNAPITRLVIHATCPDVGYPSASKAGRAVSTAHYFAEATRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGPYFPWNEFIAAVQGKTTNKGELSMSDVNTPTKLIKASNDQLHYDIGVVQTQNGTLKSKIENLSWVKNPVTGKKWSTKDALWSVWYYVLECRNRIQAIENRLSEIERKAK

SEQ ID NO: 8 - protein, 281 aa, unidentified
  REGION 1..281: note = Cutibacterium avidum
MTFIQARHHGGNSNTPITRLVIHATCPDVGYPSASRAGRAASTANYFATTDRPASAHYVCDIATTVQCLSEEVIGFHAPPNSHSIGIEICADGGSHASFEKASHAYTREQWLSDDVWPAVERAAILARGICHRHHIPVRKLSTAQVKSGMSGICGHDNVSDAFHQSDHDDPGPHFPWNEFIAAVQGKTTNKGELSMSDVNTLTKLIKASNDQLHYDIGVVQTQNGTLKSKIDNLSWVKNPVTGKKWSTKDALWSVWYYILECRNRIMTLENRISDLEKKVK

SEQ ID NO: 9 - protein, 282 aa, unidentified
  REGION 1..282: note = Cutibacterium avidum
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARGICHRHHIPVRKLTTAQVKNGMSGICGHDNVSDAFHQSDHDDPGPYFPWDKFIAAVQGKNTTSEGELSMSDINTLTKLIKASNDQLHYDIGVVQTQNGTLKSKIENLSWVKNPVTGKKWSTKDALWSVWYYVLECRNRIQAIENRLSEIERKAK

SEQ ID NO: 10 - protein, 279 aa, unidentified
  REGION 1..279: note = Cutibacterium porci
MQFIQAKHHGGNENTPVTRLVIHATCPDTGYPSASRAGRAASTARYFQSTSRPTSAHYVCDVTATVQCLSEETIGYHAPPNAHSIGIEICADGGSKSSFDNPSHSYTREQWLSPQVWPAVERAAILARDICHRHHIPVRKLSTAQVKSGMSGICGHDNVSDAFHQSDHDDPGPYFPWDRFMAAITNTHPEELTMADVKELKASIVSAQQQLHHDVGVVQNQNGMLKKQIENLSWVKNPVTGKLWRTKDALWSIWYYILEVRTRLQKIENRLSDLERKVK

SEQ ID NO: 11 - protein, 282 aa, unidentified
  REGION 1..282: note = Cutibacterium granulosum DSM 20700
MTFIQAAHRGGTSNTPITRLVIHATCPDVGFPSASRAGRAVSTAEYFASTSRSASAHYVCDISTTVQCLSEATIGYHAPPNAHSIGIEICAAGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDVNTLTKLIKASNDQLHYDIGVVQTQNGNIKKKIDNLSWVKNPVTGKKWSTKDALWSVWYYVLECRNRIQAIENRIYDLEKKVK

SEQ ID NO: 12 - protein, 282 aa, unidentified
  REGION 1..282: note = Cutibacterium avidum
MTFIQARHHGGNTNAPVSRLVIHSTCPDVGFPSASRAGRAVSTAEYFASTSRPASAHYVVDIATTVQCLPENTIGYHAPPNSHSIGIEICSDGGSRASFEKASHAYTREQWLSPQVWPAVERAAILARDICHRHRIPVRKLSTAQVKNGMSGICGHDNVSDAFHQSDHDDPGLYFPWDRFIAAIQGKNTTTKGELSMSDVNTLTKLIKASNNQLHHDIGVVQTQNGSLKKQVELLSWVKNPATGKKWRTKDALWSVWYYVLECRNRIMTIENRISDLEKKVK

SEQ ID NO: 13 - protein, 282 aa, unidentified
  REGION 1..282: note = Propionibacterium sp. KPL2005
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARDICHRHRIPVRKLSTAQVKNGMSGICGHDNVSDAFHQSDHDDPGPYFPWDKFIAAVQGKNTTSEGELSMSDINTLTKLIKASNNQLHHDVSVVQTQNGSLKKQVELLSWVKNPVNGKLWRTKDALWSVWYYVLECRNRIMTIENRISDLEKKVK

SEQ ID NO: 14 - protein, 283 aa, unidentified
  REGION 1..283: note = Cutibacterium avidum
MTFIQAKHHGGHNNPPVTRLVIHATCPDVGYPSASRAGRAVSTAHYFQETTRPASAHYICDISTTVQCLSEETVGYHAPPNSHSIGIEICADGGSHASFSNPAHAYTREQWLSPQVWPAVERAAMLARGICQRHNIPIRRLSIADVKAGKRGICGHNEVSEAFHQSDHDDPGPYFPWDGFIALVNGHSAPSRQEELTVSDVNMLKGLIQQSNKQLHHDIGVVQTQAGNLRRQLESLSWVKNPVSGKLWRTKDALWSIWYYVLDCRSRLGKLEARLSTLEKKVK

SEQ ID NO: 15 - protein, 324 aa, unidentified
  REGION 1..324: note = Caudoviricetes sp.
MRYIQAKHHGGASNKPVTRLVIHSTCPDVGFPSASRAGRAESTANYFADSSRPASAHYVCDVSTTIQCLHEDVVGYHAPPNSHSIGIEICSDGGSRASFRNPNHAYTREQWLSPQVWPAVERAAVLARDICKRNGIPIRKLSTSEVKAGRSGICGHNNVSDAFHQSDHDDPGPYFPWDKFIAAVNGAKVTSEGALSMSDVNSLTKLIKSSHDQLHHDIGVVQTQSGNLKKEVDLLSWVKNPLTGKLYRTKDALWSMWRYIFEANDRTKKLEERVDLLSQVLNPVSGKLYKTKDALWSMWRYILEVNDRVKNIEDRINADDKKVK

SEQ ID NO: 16 - protein, 282 aa, unidentified
  REGION 1..282: note = Caudoviricetes sp.
MRYIQAKHHGAASNKPVTRLVIHSTCPDVGFPSASRAGRAESTANYFADSSRPASAHYVCDVSTTIQCLHEDIVGYHAPPNSHSIGIEICSDGGSHASFNNPKHAYTRDQWLSPQVWPAVERAAVLARDICKRNGIPIRKLSTSEVKAGRSGICGHNNVSDAFHQSDHDDPGPYFPWDKFIAAVNGAKVTSEGALSMSDVNSLTKLIKTSSEQLHHDIGVVQTQNGNLKKEVDLLSWIKNPVSGKLWRTKDAIWSMWYYILELRNRVQNIEDRINAGGKKVK

SEQ ID NO: 17 - protein, 264 aa, unidentified
  REGION 1..264: note = Cutibacterium avidum
MTYIPAAHHGPTTNAPVSRIVIHSTCPDVGFPAASKAGRAVSTANYFASTSRPASAHYVVDIATTVQCLPENTVGYHAPPNSGSIGIEICSDGGSKGSFENPAHAYTTTQWLSPEVWPAVERAAILAREICHRHHIPIRRLSVAQVRAGERGICGHNEVSEAFHRSDHDDPGPWFPWDRFILEVKGIPTEGMSMSDIQNIIQRLSRIEAIVTVNQRRIDKATAIATENQRRITDIKSGLDHTDRVAVENQRRINRITAKLEASE

SEQ ID NO: 18 - protein, 281 aa, unidentified
  REGION 1..281: note = Cutibacterium avidum
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVNTLTKLIKASNNQLHHDIGVVQTQNGTLKSKIDNLSWVKNPVTGKKWSTKDALWSVWYYVLECRNRIQAIENRLSDIEKKVK

SEQ ID NO: 19 - protein, 282 aa, unidentified
  REGION 1..282: note = Cutibacterium avidum
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARDICHRHRIPVRKLSTAQVKNGMSGICGHDNVSDAFHQSDHDDPGPYFPWDKFIAAVQGKNTTSEGELSMSDINTLTKLIKASNDQLHYDIGVVQTQNGTLKSKIENLSWVKNPVTGKKWSTKDALWSVWYYVLECRNRIQAIENRLSEIERKAK

SEQ ID NO: 20 - protein, 161 aa, synthetic construct
SNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGP

SEQ ID NO: 21 - protein, 161 aa, synthetic construct
SNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGP

SEQ ID NO: 22 - protein, 161 aa, synthetic construct
SNAPITRLVIHATCPDVGYPSASKAGRAVSTANYFATTDRPASAHYVCDIATTVQCLSEETIGYHAPPNSHSIGIEICADGGSHASFEKASHAYTRDQWLSDDVWPAVERAAILARDICQRHRIPVRKLSTAQVKAGLSGICGHDNVSGAFHQSDHDDPGP

SEQ ID NO: 23 - protein, 161 aa, synthetic construct
SNAPITRLVIHATCPDVGYPSASKAGRAVSTAEYFASTSRSASAHYVCDIAATVQCLSEEAIGFHAPPNSHSIGIEICADGGSRASFEKASHAYTREQWLSPQVWPAVERAAILARDICRRHHIPVRKLTTAQVKSGMSGICGHDNVSDAFHQSDHDDPGP

SEQ ID NO: 24 - protein, 161 aa, synthetic construct
SNTPVTRLVIHATCPDVGYPSASKAGRAVSTAEYFASTSRSASAHYVCDVSATVQCLSEEAIGYHAPPNSHSIGIEICADGGSHASFETASHAYTREQWLSPQVWPAVERAAILARDICHRHHIPVRKLTTAQVKSGMSGICGHDNVSDAFRQSDHDDPGP

SEQ ID NO: 25 - protein, 161 aa, synthetic construct
SNNPVTRLVIHATCPDVGYPSASKAGRAVSTAQYFASTSRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGP

SEQ ID NO: 26 - protein, 161 aa, synthetic construct
SNAPITRLVIHATCPDVGYPSASKAGRAVSTAHYFAEATRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGP

SEQ ID NO: 27 - protein, 161 aa, synthetic construct
SNTPITRLVIHATCPDVGYPSASRAGRAASTANYFATTDRPASAHYVCDIATTVQCLSEEVIGFHAPPNSHSIGIEICADGGSHASFEKASHAYTREQWLSDDVWPAVERAAILARGICHRHHIPVRKLSTAQVKSGMSGICGHDNVSDAFHQSDHDDPGP

SEQ ID NO: 28 - protein, 161 aa, synthetic construct
TNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARGICHRHHIPVRKLTTAQVKNGMSGICGHDNVSDAFHQSDHDDPGP

SEQ ID NO: 29 - protein, 160 aa, synthetic construct
NTPVTRLVIHATCPDTGYPSASRAGRAASTARYFQSTSRPTSAHYVCDVTATVQCLSEETIGYHAPPNAHSIGIEICADGGSKSSFDNPSHSYTREQWLSPQVWPAVERAAILARDICHRHHIPVRKLSTAQVKSGMSGICGHDNVSDAFHQSDHDDPGP

SEQ ID NO: 30 - protein, 161 aa, synthetic construct
SNTPITRLVIHATCPDVGFPSASRAGRAVSTAEYFASTSRSASAHYVCDISTTVQCLSEATIGYHAPPNAHSIGIEICAAGGSRASFEKASHAYTREQWLSPQVWPAVERAAILARDICHRHHIPIRRLSVAQVRAGERGICGHNEVSEAFHQSDHDDPGP

SEQ ID NO: 31 - protein, 160 aa, synthetic construct
TNAPVSRLVIHSTCPDVGFPSASRAGRAVSTAEYFASTSRPASAHYVVDIATTVQCLPENTIGYHAPPNSHSIGIEICSDGGSRASFEKASHAYTREQWLSPQVWPAVERAAILARDICHRHRIPVRKLSTAQVKNGMSGICGHDNVSDAFHQSDHDDPG

SEQ ID NO: 32 - protein, 161 aa, synthetic construct
TNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARDICHRHRIPVRKLSTAQVKNGMSGICGHDNVSDAFHQSDHDDPGP

SEQ ID NO: 33 - protein, 161 aa, synthetic construct
NNPPVTRLVIHATCPDVGYPSASRAGRAVSTAHYFQETTRPASAHYICDISTTVQCLSEETVGYHAPPNSHSIGIEICADGGSHASFSNPAHAYTREQWLSPQVWPAVERAAMLARGICQRHNIPIRRLSIADVKAGKRGICGHNEVSEAFHQSDHDDPGP

SEQ ID NO: 34 - protein, 161 aa, synthetic construct
SNKPVTRLVIHSTCPDVGFPSASRAGRAESTANYFADSSRPASAHYVCDVSTTIQCLHEDVVGYHAPPNSHSIGIEICSDGGSRASFRNPNHAYTREQWLSPQVWPAVERAAVLARDICKRNGIPIRKLSTSEVKAGRSGICGHNNVSDAFHQSDHDDPGP

SEQ ID NO: 35 - protein, 161 aa, synthetic construct
SNKPVTRLVIHSTCPDVGFPSASRAGRAESTANYFADSSRPASAHYVCDVSTTIQCLHEDIVGYHAPPNSHSIGIEICSDGGSHASFNNPKHAYTRDQWLSPQVWPAVERAAVLARDICKRNGIPIRKLSTSEVKAGRSGICGHNNVSDAFHQSDHDDPGP

SEQ ID NO: 36 - protein, 161 aa, synthetic construct
TNAPVSRIVIHSTCPDVGFPAASKAGRAVSTANYFASTSRPASAHYVVDIATTVQCLPENTVGYHAPPNSGSIGIEICSDGGSKGSFENPAHAYTTTQWLSPEVWPAVERAAILAREICHRHHIPIRRLSVAQVRAGERGICGHNEVSEAFHRSDHDDPGP

SEQ ID NO: 37 - protein, 273 aa, unidentified
  REGION 1..273: note = Cutibacterium avidum
MKNWNSLEADENRLMNKHYTPGRGGKRIDKVIIHHNVGNLTIKGCWDVWQDRQASAHYQVESSGRIGQLVWDRDTAWHAGNWNANTTSIGVEHADASSNPWAVSEACLDNGAHLVAAICKYYGLGRPVWGTNVFGHRHFSSTECPASLAGTQHAAYMARAQYWYDQMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 38 - protein, 199 aa, unidentified
  REGION 1..199: note = Cutibacterium acnes
MIIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 39 - protein, 255 aa, unidentified
  REGION 1..255: note = Propionimicrobium lymphoophilum
MSYNFITKYDSPNYGQIYGPIALPCRKLTIHWWGSPSGQDPYGIINYLCRANGNSSAHAVVWPGNVACIVNYDRAAWHAGNAAGNQTSIGLELDPNHIDATIETVAEYIADLIRQGVLDRNFDIYGHKDWSSTACPGAYHGRIAEIKAKALARLDGKPSAKPAPKASAANIERLAHDVINGKFGNGDERRRRLGASYDAVQARVNQMLGADAGPNIEQLANDVIAGKYGNGEARRVALGASYDAVQARVNQMLGV

SEQ ID NO: 40 - protein, 258 aa, unidentified
  REGION 1..258: note = Propionimicrobium lymphoophilum
MSYNFHTQYNSPNYGQIYGPIRLPCRRLTIHWWDDPARNPQPMSVINGLCNPNRGASAHAVVWPGNVACIVDYDKAAWHAGNATGNQSSIGLELDPCHVDETIETVAEYIADLIREGVLARDFEIYGHKDWSATACPGAYYGRLAEIKAKALAHLAGKAAPAAKPATTSSPNIEQLARDVIAGGYGNGETRRAALGASYDVVQARVNQILKAGSLAPNIEQLARDVIAGKYGNGETRRAALGASYDVVQARVNQMLGV

SEQ ID NO: 41 - protein, 107 aa, synthetic construct
MTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 42 - protein, 64 aa, synthetic construct
HMTGNTPAPAPAPKPAPTPKPAPNIDALADAVIRGEYGNGNERRRRLGSNYDAVQRRVNEKLRH

SEQ ID NO: 43 - protein, 105 aa, synthetic construct
LARLDGKPSAKPAPKASAANIERLAHDVINGKFGNGDERRRRLGASYDAVQARVNQMLGADAGPNIEQLANDVIAGKYGNGEARRVALGASYDAVQARVNQMLGV

SEQ ID NO: 44 - protein, 106 aa, synthetic construct
AHLAGKAAPAAKPATTSSPNIEQLARDVIAGGYGNGETRRAALGASYDVVQARVNQILKAGSLAPNIEQLARDVIAGKYGNGETRRAALGASYDVVQARVNQMLGV

SEQ ID NO: 45 - protein, 39 aa, synthetic construct
IDALADAVIRGEYGNGEERRRRLGANYAAVQKRVNEKLT

SEQ ID NO: 46 - protein, 39 aa, synthetic construct
IDALADAVIRGDYGNGEERRRRLGNLYDQVQARVNQKLG

SEQ ID NO: 47 - protein, 38 aa, synthetic construct
IDALADAVIRGEYGNGNERRRRLGSNYDAVQRRVNEKL

SEQ ID NO: 48 - protein, 39 aa, synthetic construct
IERLAHDVINGKFGNGDERRRRLGASYDAVQARVNQMLG

SEQ ID NO: 49 - protein, 39 aa, synthetic construct
IEQLANDVIAGKYGNGEARRVALGASYDAVQARVNQMLG

SEQ ID NO: 50 - protein, 39 aa, synthetic construct
IEQLARDVIAGGYGNGETRRAALGASYDVVQARVNQILK

SEQ ID NO: 51 - protein, 39 aa, synthetic construct
IEQLARDVIAGKYGNGETRRAALGASYDVVQARVNQMLG

SEQ ID NO: 52 - protein, 308 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVTSMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 53 - protein, 265 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVTSHMTGNTPAPAPAPKPAPTPKPAPNIDALADAVIRGEYGNGNERRRRLGSNYDAVQRRVNEKLRH

SEQ ID NO: 54 - protein, 306 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVTSLARLDGKPSAKPAPKASAANIERLAHDVINGKFGNGDERRRRLGASYDAVQARVNQMLGADAGPNIEQLANDVIAGKYGNGEARRVALGASYDAVQARVNQMLGV

SEQ ID NO: 55 - protein, 307 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVTSAHLAGKAAPAAKPATTSSPNIEQLARDVIAGGYGNGETRRAALGASYDVVQARVNQILKAGSLAPNIEQLARDVIAGKYGNGETRRAALGASYDVVQARVNQMLGV

SEQ ID NO: 56 - protein, 308 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 57 - protein, 265 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSHMTGNTPAPAPAPKPAPTPKPAPNIDALADAVIRGEYGNGNERRRRLGSNYDAVQRRVNEKLRH

SEQ ID NO: 58 - protein, 308 aa, synthetic construct
MTFIQARHHGGNSNAPITRLVIHATCPDVGYPSASKAGRAVSTANYFATTDRPASAHYVCDIATTVQCLSEETIGYHAPPNSHSIGIEICADGGSHASFEKASHAYTRDQWLSDDVWPAVERAAILARDICQRHRIPVRKLSTAQVKAGLSGICGHDNVSGAFHQSDHDDPGPYFPWDQFMALVQGKPATPGDLTMADITSMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 59 - protein, 265 aa, synthetic construct
MTFIQARHHGGNSNAPITRLVIHATCPDVGYPSASKAGRAVSTANYFATTDRPASAHYVCDIATTVQCLSEETIGYHAPPNSHSIGIEICADGGSHASFEKASHAYTRDQWLSDDVWPAVERAAILARDICQRHRIPVRKLSTAQVKAGLSGICGHDNVSGAFHQSDHDDPGPYFPWDQFMALVQGKPATPGDLTMADITSHMTGNTPAPAPAPKPAPTPKPAPNIDALADAVIRGEYGNGNERRRRLGSNYDAVQRRVNEKLRH

SEQ ID NO: 60 - protein, 270 aa, unidentified
  REGION 1..270: note = Clostridioides difficile
MKICITVGHSILKSGACTSADGVVNEYQYNKSLAPVLADTFRKEGHKVDVIICPEKQFKTKNEEKSYKIPRVNSGGYDLLIELHLNASNGQGKGSEVLYYSNKGLEYATRICDKLGTVFKNRGAKLDKRLYILNSSKPTAVLIESFFCDNKEDYDKAKKLGHEGIAKLIVEGVLNKNINNEGVKQMYKHTIVYDGEVDKISATVVGWGYNDGKILICDIKDYVPGQTQNLYVVGGGACEKISSITKEKFIMIKGNDRFDTLYKALDFINR

SEQ ID NO: 61 - protein, 233 aa, unidentified
  REGION 1..233: note = Geobacillus virus E2
MKKIFWDKGHGGSDPGAVANGLQEKNLTHKIVEYATDYLAAHYEGFTQRVSREGDQSLTLDQRADMANKWGADVFVSVHINAGKGTGFEIYVHPNASPQSIALQNVLHGEILSAMRQFGNITDRGKKRANYAVLRETKMPAVLTENLFIDSNDAKHLKNEAFLKAVGEAHARGVAKFLGLKEKQKAQPEAKPQQKPSDKKLYRVQVGAFADRENAERLAEELKRKGYPVYITD

SEQ ID NO: 62 - protein, 227 aa, unidentified
  REGION 1..227: note = Deep-sea thermophilic phage D6E
MVRIVLDAGHGGKDSGAVGNGLREKDLTLNIVKKIGNLLAEYEGVEVHYTRTDDRFLELSERAEIANRLKADYFISVHINAGGGTGFESYIYNGNVSSATIAYQNVIHSEIMKAIGNVTDRGKKRANYAVLRETHMPALLTENLFIDNKNDAAKLDSEQFLLQVAHGHVQGIVKAFGLKKKATPQPQQKVSDKKLYRVQVGAFADRKNAERLADELKKKGYPVYITD

SEQ ID NO: 63 - protein, 199 aa, synthetic construct
MKICITVGHSILKSGACTSADGVVNEYQYNKSLAPVLADTFRKEGHKVDVIICPEKQFKTKNEEKSYKIPRVNSGGYDLLIELHLNASNGQGKGSEVLYYSNKGLEYATRICDKLGTVFKNRGAKLDKRLYILNSSKPTAVLIESFFCDNKEDYDKAKKLGHEGIAKLIVEGVLNKNINNEGVKQMYKHTIVYDGEVDK

SEQ ID NO: 64 - protein, 181 aa, synthetic construct
MKKIFWDKGHGGSDPGAVANGLQEKNLTHKIVEYATDYLAAHYEGFTQRVSREGDQSLTLDQRADMANKWGADVFVSVHINAGKGTGFEIYVHPNASPQSIALQNVLHGEILSAMRQFGNITDRGKKRANYAVLRETKMPAVLTENLFIDSNDAKHLKNEAFLKAVGEAHARGVAKFLGLK

SEQ ID NO: 65 - protein, 183 aa, synthetic construct
MVRIVLDAGHGGKDSGAVGNGLREKDLTLNIVKKIGNLLAEYEGVEVHYTRTDDRFLELSERAEIANRLKADYFISVHINAGGGTGFESYIYNGNVSSATIAYQNVIHSEIMKAIGNVTDRGKKRANYAVLRETHMPALLTENLFIDNKNDAAKLDSEQFLLQVAHGHVQGIVKAFGLKKKAT

SEQ ID NO: 66 - protein, 308 aa, synthetic construct
MKICITVGHSILKSGACTSADGVVNEYQYNKSLAPVLADTFRKEGHKVDVIICPEKQFKTKNEEKSYKIPRVNSGGYDLLIELHLNASNGQGKGSEVLYYSNKGLEYATRICDKLGTVFKNRGAKLDKRLYILNSSKPTAVLIESFFCDNKEDYDKAKKLGHEGIAKLIVEGVLNKNINNEGVKQMYKHTIVYDGEVDKTSMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 67 - protein, 265 aa, synthetic construct
MKICITVGHSILKSGACTSADGVVNEYQYNKSLAPVLADTFRKEGHKVDVIICPEKQFKTKNEEKSYKIPRVNSGGYDLLIELHLNASNGQGKGSEVLYYSNKGLEYATRICDKLGTVFKNRGAKLDKRLYILNSSKPTAVLIESFFCDNKEDYDKAKKLGHEGIAKLIVEGVLNKNINNEGVKQMYKHTIVYDGEVDKTSHMTGNTPAPAPAPKPAPTPKPAPNIDALADAVIRGEYGNGNERRRRLGSNYDAVQRRVNEKLRH

SEQ ID NO: 68 - protein, 290 aa, synthetic construct
MKKIFWDKGHGGSDPGAVANGLQEKNLTHKIVEYATDYLAAHYEGFTQRVSREGDQSLTLDQRADMANKWGADVFVSVHINAGKGTGFEIYVHPNASPQSIALQNVLHGEILSAMRQFGNITDRGKKRANYAVLRETKMPAVLTENLFIDSNDAKHLKNEAFLKAVGEAHARGVAKFLGLKTSMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 69 - protein, 247 aa, synthetic construct
MKKIFWDKGHGGSDPGAVANGLQEKNLTHKIVEYATDYLAAHYEGFTQRVSREGDQSLTLDQRADMANKWGADVFVSVHINAGKGTGFEIYVHPNASPQSIALQNVLHGEILSAMRQFGNITDRGKKRANYAVLRETKMPAVLTENLFIDSNDAKHLKNEAFLKAVGEAHARGVAKFLGLKTSHMTGNTPAPAPAPKPAPTPKPAPNIDALADAVIRGEYGNGNERRRRLGSNYDAVQRRVNEKLRH

SEQ ID NO: 70 - protein, 292 aa, synthetic construct
MVRIVLDAGHGGKDSGAVGNGLREKDLTLNIVKKIGNLLAEYEGVEVHYTRTDDRFLELSERAEIANRLKADYFISVHINAGGGTGFESYIYNGNVSSATIAYQNVIHSEIMKAIGNVTDRGKKRANYAVLRETHMPALLTENLFIDNKNDAAKLDSEQFLLQVAHGHVQGIVKAFGLKKKATTSMTGNTPAPKPAPAPAPAPNIDALADAVIRGEYGNGEERRRRLGANYAAVQKRVNEKLTGHAPAPTPNIDALADAVIRGDYGNGEERRRRLGNLYDQVQARVNQKLGY

SEQ ID NO: 71 - protein, 249 aa, synthetic construct
MVRIVLDAGHGGKDSGAVGNGLREKDLTLNIVKKIGNLLAEYEGVEVHYTRTDDRFLELSERAEIANRLKADYFISVHINAGGGTGFESYIYNGNVSSATIAYQNVIHSEIMKAIGNVTDRGKKRANYAVLRETHMPALLTENLFIDNKNDAAKLDSEQFLLQVAHGHVQGIVKAFGLKKKATTSHMTGNTPAPAPAPKPAPTPKPAPNIDALADAVIRGEYGNGNERRRRLGSNYDAVQRRVNEKLRH

SEQ ID NO: 72 - protein, 284 aa, unidentified
  REGION 1..284: note = Propionibacterium phage ATCC29399B_T
MRYIPAAHHSAGSNHPVNRVVIHATCPDVGFPSASRKGRAVSTANYFASPSSGGSAHYVCDIGETVQCLSEGTIGWHAPPNPHSLGIEICADGGSHASFRVPGHAYTREQWLDPRVWPAVEKAAILCRRLCDKYNVPKRKLSAADLKAGRRGVCGHVDVTDAWHQSDHDDPGPWFPWDRFMAVVNGHNESGELTVADVKALHDQIKQLSAQLAGSVNKLHHDVGVVQVQNGDLGKRVDALSWVKNPVTGKLWRTKDALWSVWYYVLECRSRIDRLESAVNGLKK

SEQ ID NO: 73 - protein, 161 aa, synthetic construct
SNHPVNRVVIHATCPDVGFPSASRKGRAVSTANYFASPSSGGSAHYVCDIGETVQCLSEGTIGWHAPPNPHSLGIEICADGGSHASFRVPGHAYTREQWLDPRVWPAVEKAAILCRRLCDKYNVPKRKLSAADLKAGRRGVCGHVDVTDAWHQSDHDDPGP

SEQ ID NO: 74 - protein, 200 aa, synthetic construct
MVRYIPAAHHSAGSNHPVNRVVIHATCPDVGFPSASRKGRAVSTANYFASPSSGGSAHYVCDIGETVQCLSEGTIGWHAPPNPHSLGIEICADGGSHASFRVPGHAYTREQWLDPRVWPAVEKAAILCRRLCDKYNVPKRKLSAADLKAGRRGVCGHVDVTDAWHQSDHDDPGPWFPWDRFMAVVNGHNESGELTVADVK

SEQ ID NO: 75 - protein, 199 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDV

SEQ ID NO: 76 - protein, 199 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSD

SEQ ID NO: 77 - protein, 199 aa, synthetic construct
MTFIQARHHGGNSNAPITRLVIHATCPDVGYPSASKAGRAVSTANYFATTDRPASAHYVCDIATTVQCLSEETIGYHAPPNSHSIGIEICADGGSHASFEKASHAYTRDQWLSDDVWPAVERAAILARDICQRHRIPVRKLSTAQVKAGLSGICGHDNVSGAFHQSDHDDPGPYFPWDQFMALVQGKPATPGDLTMADI

SEQ ID NO: 78 - protein, 199 aa, synthetic construct
MTFIQARHHGGNSNAPITRLVIHATCPDVGYPSASKAGRAVSTAEYFASTSRSASAHYVCDIAATVQCLSEEAIGFHAPPNSHSIGIEICADGGSRASFEKASHAYTREQWLSPQVWPAVERAAILARDICRRHHIPVRKLTTAQVKSGMSGICGHDNVSDAFHQSDHDDPGPYFPWNEFIAAVQGKNTNKGELSMSDV

SEQ ID NO: 79 - protein, 199 aa, synthetic construct
MTFIQARHHGGNSNTPVTRLVIHATCPDVGYPSASKAGRAVSTAEYFASTSRSASAHYVCDVSATVQCLSEEAIGYHAPPNSHSIGIEICADGGSHASFETASHAYTREQWLSPQVWPAVERAAILARDICHRHHIPVRKLTTAQVKSGMSGICGHDNVSDAFRQSDHDDPGPYFPWNEFIAAVQGKTTNKGELSMSDV

SEQ ID NO: 80 - protein, 199 aa, synthetic construct
MTFIQARHHGGNSNNPVTRLVIHATCPDVGYPSASKAGRAVSTAQYFASTSRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGPYFPWNEFIAAVQGKNTNKGELSMSDV

SEQ ID NO: 81 - protein, 199 aa, synthetic construct
MTFIQARHHGGNSNAPITRLVIHATCPDVGYPSASKAGRAVSTAHYFAEATRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGPYFPWNEFIAAVQGKTTNKGELSMSDV

SEQ ID NO: 82 - protein, 199 aa, synthetic construct
MTFIQARHHGGNSNTPITRLVIHATCPDVGYPSASRAGRAASTANYFATTDRPASAHYVCDIATTVQCLSEEVIGFHAPPNSHSIGIEICADGGSHASFEKASHAYTREQWLSDDVWPAVERAAILARGICHRHHIPVRKLSTAQVKSGMSGICGHDNVSDAFHQSDHDDPGPHFPWNEFIAAVQGKTTNKGELSMSDV

SEQ ID NO: 83 - protein, 200 aa, synthetic construct
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARGICHRHHIPVRKLTTAQVKNGMSGICGHDNVSDAFHQSDHDDPGPYFPWDKFIAAVQGKNTTSEGELSMSDI

SEQ ID NO: 84 - protein, 197 aa, synthetic construct
MQFIQAKHHGGNENTPVTRLVIHATCPDTGYPSASRAGRAASTARYFQSTSRPTSAHYVCDVTATVQCLSEETIGYHAPPNAHSIGIEICADGGSKSSFDNPSHSYTREQWLSPQVWPAVERAAILARDICHRHHIPVRKLSTAQVKSGMSGICGHDNVSDAFHQSDHDDPGPYFPWDRFMAAITNTHPEELTMADV

SEQ ID NO: 85 - protein, 200 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICAAGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDV

SEQ ID NO: 86 - protein, 200 aa, synthetic construct
MTFIQARHHGGNTNAPVSRLVIHSTCPDVGFPSASRAGRAVSTAEYFASTSRPASAHYVVDIATTVQCLPENTIGYHAPPNSHSIGIEICSDGGSRASFEKASHAYTREQWLSPQVWPAVERAAILARDICHRHRIPVRKLSTAQVKNGMSGICGHDNVSDAFHQSDHDDPGLYFPWDRFIAAIQGKNTTTKGELSMSDV

SEQ ID NO: 87 - protein, 200 aa, synthetic construct
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARDICHRHRIPVRKLSTAQVKNGMSGICGHDNVSDAFHQSDHDDPGPYFPWDKFIAAVQGKNTTSEGELSMSDI

SEQ ID NO: 88 - protein, 202 aa, synthetic construct
MTFIQAKHHGGHNNPPVTRLVIHATCPDVGYPSASRAGRAVSTAHYFQETTRPASAHYICDISTTVQCLSEETVGYHAPPNSHSIGIEICADGGSHASFSNPAHAYTREQWLSPQVWPAVERAAMLARGICQRHNIPIRRLSIADVKAGKRGICGHNEVSEAFHQSDHDDPGPYFPWDGFIALVNGHSAPSRQEELTVSDVH

SEQ ID NO: 89 - protein, 200 aa, synthetic construct
MRYIQAKHHGGASNKPVTRLVIHSTCPDVGFPSASRAGRAESTANYFADSSRPASAHYVCDVSTTIQCLHEDVVGYHAPPNSHSIGIEICSDGGSRASFRNPNHAYTREQWLSPQVWPAVERAAVLARDICKRNGIPIRKLSTSEVKAGRSGICGHNNVSDAFHQSDHDDPGPYFPWDKFIAAVNGAKVTSEGALSMSDV

SEQ ID NO: 90 - protein, 200 aa, synthetic construct
MRYIQAKHHGAASNKPVTRLVIHSTCPDVGFPSASRAGRAESTANYFADSSRPASAHYVCDVSTTIQCLHEDIVGYHAPPNSHSIGIEICSDGGSHASFNNPKHAYTRDQWLSPQVWPAVERAAVLARDICKRNGIPIRKLSTSEVKAGRSGICGHNNVSDAFHQSDHDDPGPYFPWDKFIAAVNGAKVTSEGALSMSDV

SEQ ID NO: 91 - protein, 197 aa, synthetic construct
MTYIPAAHHGPTTNAPVSRIVIHSTCPDVGFPAASKAGRAVSTANYFASTSRPASAHYVVDIATTVQCLPENTVGYHAPPNSGSIGIEICSDGGSKGSFENPAHAYTTTQWLSPEVWPAVERAAILAREICHRHHIPIRRLSVAQVRAGERGICGHNEVSEAFHRSDHDDPGPWFPWDRFILEVKGIPTEGMSMSDI

SEQ ID NO: 92 - protein, 199 aa, synthetic construct; identical to SEQ ID NO: 75

SEQ ID NO: 93 - protein, 200 aa, synthetic construct; identical to SEQ ID NO: 87

SEQ ID NO: 94 - protein, 265 aa, synthetic construct
MTFIQARHHGGNSNAPITRLVIHATCPDVGYPSASKAGRAVSTAEYFASTSRSASAHYVCDIAATVQCLSEEAIGFHAPPNSHSIGIEICADGGSRASFEKASHAYTREQWLSPQVWPAVERAAILARDICRRHHIPVRKLTTAQVKSGMSGICGHDNVSDAFHQSDHDDPGPYFPWNEFIAAVQGKNTNKGELSMSDVTSHMTGNTPAPAPAPKPAPTPKPAPNIDALADAVIRGEYGNGNERRRRLGSNYDAVQRRVNEKLRH

SEQ ID NO: 95 - protein, 265 aa, synthetic construct
MTFIQARHHGGNSNTPVTRLVIHATCPDVGYPSASKAGRAVSTAEYFASTSRSASAHYVCDVSATVQCLSEEAIGYHAPPNSHSIGIEICADGGSHASFETASHAYTREQWLSPQVWPAVERAAILARDICHRHHIPVRKLTTAQVKSGMSGICGHDNVSDAFRQSDHDDPGPYFPWNEFIAAVQGKTTNKGELSMSDVTSHMTGNTPAPAPAPKPAPTPKPAPNIDALADAVIRGEYGNGNERRRRLGSNYDAVQRRVNEKLRH

SEQ ID NO: 96 - protein, 265 aa, synthetic construct
MTFIQARHHGGNSNNPVTRLVIHATCPDVGYPSASKAGRAVSTAQYFASTSRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGPYFPWNEFIAAVQGKNTNKGELSMSDVTSHMTGNTPAPAPAPKPAPTPKPAPNIDALADAVIRGEYGNGNERRRRLGSNYDAVQRRVNEKLRH

SEQ ID NO: 97 - protein, 265 aa, synthetic construct
MTFIQARHHGGNSNAPITRLVIHATCPDVGYPSASKAGRAVSTAHYFAEATRPASAHYVCDVSATVQCLSEETIGYHAPPNAHSIGIEICSDGGSRASFEKASHAYSREQWLSPQVWPAVERAAILARDICHRHRIPVRKLTAAQVKSGMSGICGHDNVSDAFRQSDHDDPGPYFPWNEFIAAVQGKTTNKGELSMSDVTSHMTGNTPAPAPAPKPAPTPKPAPNIDALADAVIRGEYGNGNERRRRLGSNYDAVQRRVNEKLRH

SEQ ID NO: 98 - protein, 265 aa, synthetic construct
MTFIQARHHGGNSNTPITRLVIHATCPDVGYPSASRAGRAASTANYFATTDRPASAHYVCDIATTVQCLSEEVIGFHAPPNSHSIGIEICADGGSHASFEKASHAYTREQWLSDDVWPAVERAAILARGICHRHHIPVRKLSTAQVKSGMSGICGHDNVSDAFHQSDHDDPGPHFPWNEFIAAVQGKTTNKGELSMSDVTSHMTGNTPAPAPAPKPAPTPKPAPNIDALADAVIRGEYGNGNERRRRLGSNYDAVQRRVNEKLRH

SEQ ID NO: 99 - protein, 266 aa, synthetic construct
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARGICHRHHIPVRKLTTAQVKNGMSGICGHDNVSDAFHQSDHDDPGPYFPWDKFIAAVQGKNTTSEGELSMSDITSHMTGNTPAPAPAPKPAPTPKPAPNIDALADAVIRGEYGNGNERRRRLGSNYDAVQRRVNEKLRH

SEQ ID NO: 100 - protein, 263 aa, synthetic construct
MQFIQAKHHGGNENTPVTRLVIHATCPDTGYPSASRAGRAASTARYFQSTSRPTSAHYVCDVTATVQCLSEETIGYHAPPNAHSIGIEICADGGSKSSFDNPSHSYTREQWLSPQVWPAVERAAILARDICHRHHIPVRKLSTAQVKSGMSGICGHDNVSDAFHQSDHDDPGPYFPWDRFMAAITNTHPEELTMADVTSHMTGNTPAPAPAPKPAPTPKPAPNIDALADAVIRGEYGNGNERRRRLGSNYDAVQRRVNEKLRH

SEQ ID NO: 101 - protein, 266 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICAAGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDVTSHMTGNTPAPAPAPKPAPTPKPAPNIDALADAVIRGEYGNGNERRRRLGSNYDAVQRRVNEKLRH

SEQ ID NO: 102 - protein, 266 aa, synthetic construct
MTFIQARHHGGNTNAPVSRLVIHSTCPDVGFPSASRAGRAVSTAEYFASTSRPASAHYVVDIATTVQCLPENTIGYHAPPNSHSIGIEICSDGGSRASFEKASHAYTREQWLSPQVWPAVERAAILARDICHRHRIPVRKLSTAQVKNGMSGICGHDNVSDAFHQSDHDDPGLYFPWDRFIAAIQGKNTTTKGELSMSDVTSHMTGNTPAPAPAPKPAPTPKPAPNIDALADAVIRGEYGNGNERRRRLGSNYDAVQRRVNEKLRH

SEQ ID NO: 103 - protein, 266 aa, synthetic construct
MTFIQARHHGGNTNAPVTRLVIHSTCPDVGFPSASRAGRAVSTAGYFASTSRPASAHYVVDVTTTVQCLPENTIGYHAPPNSHSIGIEICSDGGSRASFENPSHAYTREQWLSPQVWPAVERAAILARDICHRHRIPVRKLSTAQVKNGMSGICGHDNVSDAFHQSDHDDPGPYFPWDKFIAAVQGKNTTSEGELSMSDITSHMTGNTPAPAPAPKPAPTPKPAPNIDALADAVIRGEYGNGNERRRRLGSNYDAVQRRVNEKLRH

SEQ ID NO: 104 - protein, 267 aa, synthetic construct
MTFIQAKHHGGHNNPPVTRLVIHATCPDVGYPSASRAGRAVSTAHYFQETTRPASAHYICDISTTVQCLSEETVGYHAPPNSHSIGIEICADGGSHASFSNPAHAYTREQWLSPQVWPAVERAAMLARGICQRHNIPIRRLSIADVKAGKRGICGHNEVSEAFHQSDHDDPGPYFPWDGFIALVNGHSAPSRQEELTVSDVTSHMTGNTPAPAPAPKPAPTPKPAPNIDALADAVIRGEYGNGNERRRRLGSNYDAVQRRVNEKLRH

SEQ ID NO: 105 - protein, 266 aa, synthetic construct
MRYIQAKHHGGASNKPVTRLVIHSTCPDVGFPSASRAGRAESTANYFADSSRPASAHYVCDVSTTIQCLHEDVVGYHAPPNSHSIGIEICSDGGSRASFRNPNHAYTREQWLSPQVWPAVERAAVLARDICKRNGIPIRKLSTSEVKAGRSGICGHNNVSDAFHQSDHDDPGPYFPWDKFIAAVNGAKVTSEGALSMSDVTSHMTGNTPAPAPAPKPAPTPKPAPNIDALADAVIRGEYGNGNERRRRLGSNYDAVQRRVNEKLRH

SEQ ID NO: 106 - protein, 266 aa, synthetic construct
MRYIQAKHHGAASNKPVTRLVIHSTCPDVGFPSASRAGRAESTANYFADSSRPASAHYVCDVSTTIQCLHEDIVGYHAPPNSHSIGIEICSDGGSHASFNNPKHAYTRDQWLSPQVWPAVERAAVLARDICKRNGIPIRKLSTSEVKAGRSGICGHNNVSDAFHQSDHDDPGPYFPWDKFIAAVNGAKVTSEGALSMSDVTSHMTGNTPAPAPAPKPAPTPKPAPNIDALADAVIRGEYGNGNERRRRLGSNYDAVQRRVNEKLRH

SEQ ID NO: 107 - protein, 263 aa, synthetic construct
MTYIPAAHHGPTTNAPVSRIVIHSTCPDVGFPAASKAGRAVSTANYFASTSRPASAHYVVDIATTVQCLPENTVGYHAPPNSGSIGIEICSDGGSKGSFENPAHAYTTTQWLSPEVWPAVERAAILAREICHRHHIPIRRLSVAQVRAGERGICGHNEVSEAFHRSDHDDPGPWFPWDRFILEVKGIPTEGMSMSDITSHMTGNTPAPAPAPKPAPTPKPAPNIDALADAVIRGEYGNGNERRRRLGSNYDAVQRRVNEKLRH

SEQ ID NO: 108 - protein, 280 aa, Corynebacterium striatum
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTPPAKPTPPAPKPSVNIDALADAVIRGEYGNGDERKRRLGSNYAAVQKRVNEKLAGRSPAKPSVNIDALADAVIRGDYGNGEERKHRLGGNYAAVQKRVNEKLGIG

SEQ ID NO: 109 - protein, 124 aa, unidentified
  REGION 1..124: note = Dermabacter hominis 1368
MARAQYWYDRMSGTKPAPTPPAKPTPPAPKPSANIDALADAVIRGEYGNGDERKRRLGSNYAAVQKRVNEKLAGGSPAKPSVNIDALTDAVIRGEYGNGEERKRRLGGNYAAVQKRVNEQLGIS

SEQ ID NO: 110 - protein, 124 aa, Corynebacterium striatum
MARAQYWYDRMSGTKPAPTPPAKPTPPTPKPSANIDALADAVIRGEYGNGDERKRRLGSNYAAVQKRVNEKLAGGSPAKPSVNIDALADAVIRGDYGNVEERKRRLGANYAAVQKRVNEKLGIG

SEQ ID NO: 111 - protein, 277 aa, unidentified
  REGION 1..277: note = Trueperella pecoris
MKNWDTLDADENQILATHFTPGRSGRRIDKIIIHHNAGNLTIAGCYQVWQTRPASAHYQVDSNGRIGQLVWDRNTAWHAGNWEANTTSIGIEHADISSNPWRISDACLDNGAHLVAALCKFYQLGRPTWGKNVFGHKNFSATECPASLAGSQHAAYMARAQYWYDQMTGKDPVPKQPAKSAPTPAPSVNIDALADAVIRGEYGNGNERKRRLGANYAAVQKRVNEKLAGNTSKPSVNIDALADAVIRGEYGNGEERKRRLGANYAVVQARVNQKLGY

SEQ ID NO: 112 - protein, 262 aa, Bifidobacterium animalis
MSYQYLTQYDAACLTPGRPYGIDAITIHWWDDPAARPTFDGVIGGFVSGARKTSAHYVAEAGRVACLVDPDDRAWACGDGVDVNSGGNDRSISIECNPRQSDGDYDTIAQLIADLRATYGDLPLYPHRHWSTTGCPGTYDLARLDRLARAKRGQKPAEPAPAPAPAPARKDIDTVAREVIAGQWGNNPQRAEKLRAAGYDANAVQARVNQMLGAPAPKPAANIDALADAVIRGDYGNGDERRRRLGANYDAVQRRVNQKLGL

SEQ ID NO: 113 - protein, 279 aa, Actinomyces sp.
MKNWNTLEADVDLIMNKHYTAGRGGRRLDKVIIHHNAGNLSIRGCWDVWQTRQASAHYQVQSDGKIGQLVWDRDTAWHAGNWNANTTSIGIEHADVSSSPWKVSEACLDNGAHLVAAICRYYKLGRPAWGKNVFGHKNFSATECPASLAESQHKAYMARAQYWYDHMTGTTPAKPTPTPKPAPSVPPNIDALADAVIRGEYGNGEERKRRLGANYTAVQRRVNEKLAGKKPAAKPSGPNIDALADAVIRGEYGNGEERKRRLGNLYDQVQKRVNQKLGY

SEQ ID NO: 114 - protein, 274 aa, unidentified
  source 1..274: note = Corynebacterium silvaticum
MKNWNTLEADDNRILAKHYTAGRGGRKIDKVIIHHNAGNLTIPGIWDVWQTRQASAHYQVDSQGRIGQLVWDSDTAWHAGNWAANTTSIGIEHADISSNPWRISDACLEEGAHLTAAVCKYYGLGRPQWGKNVFGHKHFSPTECPASLAGTQHAAYMARAQYWYDQMTGTTPTPKPQPTPTPAANIDALADAVIRGDYGNGNERKRRLGANYAAVQKRVNEKLAGGSPSKPSANIDALADSVIRGDYGNGDERRRRLGENYVAVQARVNQKLGY

SEQ ID NO: 115 - protein, 280 aa, unidentified
  REGION 1..280: note = Cutibacterium avidum
MKNWATLEADENRLMNKHYTKGRNGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRLSGTKPAPTPPAKPTPPAPKPSANIDALADAVIRGEYGNGEERKRRLGANYTAVQKRVNEKLTGGSPAKPSANIDALADAVIRGEYGNGEERKRRLGGNYAAVQKRVNEKLGIG

SEQ ID NO: 116 - protein, 273 aa, Actinobaculum suis
MKNWNTLEADENRILAKHYTAGRGGRSINKVIIHHNAGNLTIPGIYEVWQTRQASAHYQVDSQGRIGQLVWDSDTAWHAGNWDANTTSIGIEHADISSNPWRISDACLEEGAHLTAAVCKYYGLGRPQWGKNVFGHKHFSPTECPASLAGTQHAAYMARAQYWYDQMTGTTPTPKPQPAPAPAPNIDALADAVIRGDYGNGNERKRHLGANYAAVQKRVNEKLAGNTSKPSVNIDALADAVIRGEYGNGEERKRRLGANYDAVQARVNQKLGY

SEQ ID NO: 117 - protein, 219 aa, unidentified
  REGION 1..219: note = Actinomycetaceae bacterium
YQVDSNGRIGQLVWDRDTAWHAGNWEANCTSIGIEHANNHVGNPWTISDATLENGAHLVAALCRYYKLGRPQWGKNVFGHKHFAATSCPGEIAGSQNSKYMTRAQYWYDHMTSGKTPAPTAKSASTPSTDIDALADAVIRGEYGNGGERKQRLGANYTAVQKRVNEKLSGAAPAKPDGPNIDALADAVIRGEYGNGDERKQRLGNLYSAVQARVNQKLG

SEQ ID NO: 118 - protein, 275 aa, Chlamydia trachomatis
MKNWNTLEADIDLIMNTHYTPGRNGRRIDKVIIHHNAGNLTIRGCYDVWQTRPASAHYQVQTDGTIGQLVWDRDTAWHAGNFAVNTTSIGIEHADVSSNPWAVSEACLDNGAHLVAAVCKFYGLGRPQWGKNVFGHKDFSATACPASLAGSQHTAYMARAQSWYDQMTGNTPAPAPAPAPAAPNIDALADAVIRGEYGNGDERKRRLGANYAAVQQRVNEKLLGNAPATKPAGPNIDALADAVIRGEYGNGEERKRRLGNLYGAVQARVNVKLGY

SEQ ID NO: 119 - protein, 275 aa, unidentified
  REGION 1..275: note = Actinomycetaceae bacterium
MKNWNTLEADENRLMNKHYTPGRGGKRIDKVIIHHNAGNLTIKGCWDVWQTRQASAHYQVQTDGRIGQLVWDRDTAWHAGNWAANTTSIGIEHADASTNPWRISEACLDNGAHLVAAICKHYGLGRPAWGKNVFGHRHFSSTECPASLADSQHAAYMARAQYWYDHMSGTKPAPAPKPTPAPTPNIDALADAVIRGEYGNGDERRRRLGNLYDQVQRRVNEKLAGKKPAPKPAPNIDALADAVIRGEYGNGDERRRRLGSLYDQVQRRVNQKLGY

SEQ ID NO: 120 - protein, 283 aa, unidentified
  REGION 1..283: note = Corynebacterium sp. HMSC074H12
MGGKQATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNCAHLVAAICHYYKLGRPVWGKNVFGHKHFSATECPASLAGSQHAAYMARAQYWYDRMSGTKPAPTPPAKPTPPAPKPSVNIDALADAVIRGEYGNGEERKRKRRLGSNYAAVQKRVNEKLTGGNPNKPSVNIDALADAVIRGDYGNGEERKRRLGGNYAAVQKRVNEKLGIS

SEQ ID NO: 121 - protein, 272 aa, unidentified
  REGION 1..272: note = Actinomycetaceae bacterium
MKNWNTLEADLNLLMNKHFTKGRQGRSINKIILHHNDGNLSIQGCWNVWQTRPASAHYQVETSGRIGQLVWDRDTAWHAGNWVANTTSIGIEHADISNSPWCISDACLEEGAHLTAAICRYYKLGQPEWGKNVYGHNHFSPTECPASLAGSQNTAYMQRAQYWYDQMTGTKPAPAPAAPSVNIDTFADAVIRGEYGNGDERKRRLGANYAAVQARVNEKLAGKAKPAGKSIETLAREVIRGDWGNGQERYNRLTNAGYNYQQVQNRVNQILN

SEQ ID NO: 122 - protein, 269 aa, unidentified
  REGION 1..269: note = uncultured Varibaculum sp.
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPCWGKNIFGHRDFSATECPASIAGSQHATYMARAIYWYDQISGNKPQAASASKPDIEALANAVIRGEYGNGDQRRARLGGLYDAVQRRVNEKLAAGSAPAAPNIDALADAVIRGDYGNGATRRARLGNLYNQVQARVNQKLGC

SEQ ID NO: 123 - protein, 315 aa, unidentified
  REGION 1..315: note = Schaalia sp. ZJ405
MYAYETGMNSPAYTHGRPGVGKPQFIVLHHWGALGQLFANVLAFLCRPGADTSAHYVVEKGKVACIVDPDDTAWHAGNWDANLRGIGIECRPEMDKADFETVAELIAELRHAYGPLPLRIHKEFFATACPGRWEAQRSALDARANALMKGAKTAAAASVSKPAASKGPNYEALADAVIRGEYGSGEERMRRLGNAYARVQAIVNARLLGGQPTPTPLPAKPAGANIDALAKAVIRGEYGTGDARRQKLGNLYDQVQARVNQILGAGATAHRAGANIDALADAVIRGEYGNGDERRVRLGANFAAVQARVNQKLAA

SEQ ID NO: 124 - protein, 280 aa, unidentified
  REGION 1..280: note = Cutibacterium granulosum
MKNWNTLEADIDLIMNKHYTAGRSGRKIDKVIIHHNAGNLSIRGCWDVWQTRQASAHYQVQSDGKIGQLVWDRDTAWHAGNWNANTTSIGIEHADISSSPWRVSDACLDNGAHLVAAICRYYKLGRPQWAKNVFGHKNFSSTECPASLAGSQHAAYMKRAQYWYDHMTGSKPAPAKPSPAKPAPSTPPNIDALADAVIHGDYGNGEERKRRLGSNHAAVQKRVNEKLAGKKPAVKPAGPNIDALADAVIRGGYGNGDERKRRLGGLYAQVQKRVNQKLGY

SEQ ID NO: 125 - protein, 146 aa, unidentified
  REGION 1..146: note = Tractidigestivibacter scatoligenes
MERQRVPPQPLREHELPGQIYGSQRGAYIGRAQLWYDRMGAGGAASASPAPTVPSPDIDALAREVIAGKYGNGDDRRRALGANYGRVQARVNEILGAGARPHSQVVDVDALARAVIRGEFGNGEERKRRLGANYAAVQRRVNELLS

SEQ ID NO: 126 - protein, 255 aa, unidentified
  REGION 1..255: note = Boudabousia tangfeifanii
MSYTIDHSHDATAFTTGRQGHRIKYIVVHHWDDPAKHPTFEGTIRWFERGGNNTSAHYVAEAGRVAQLVADGNTAYHAGNWVKNLESIGIECNPRCSDADKATVAELIRDLQAKHGPLTILGHKDCSSTDCPGRYYPPTTVLAPWLGGGGGNGRSASGVDSPSGDLNALADAVLRGDYGNGDERKRRLGSKYSAVQAIVNQRLGYGSTPVSSGPDLNALADAVIRGEYGNGDERRRRLGANYKAVQALVNKKLGY

SEQ ID NO: 127 - protein, 340 aa, unidentified
  REGION 1..340: note = Caudoviricetes sp.
MKGIDISDYQRGLDLTKIDYDFVFCKATEGIDKVYSTCDPFIQTAISQKKLYGFYHFLDQSDPVKQAEFFYANCKNYFGKGIPMLDYEEYGRIGTDKAKLFLDKIYELTGVRCIVYMSRNVTTEEDWSQIAKNHALWVAQYAGNNDTGYQDSPWLPDGGFGAWNSCVIHQYSSHGRLNGYDKYLDLDIAFMDKQAWFKYVHGERVETGVAAENCPDGSTANLAAAVMRGEYGNGDERRKRLGSRYDEVQALINRVSSSSVDDLAKDVLNGVFGNGDTRRAVLGSRYDEVQARVNARSSSVDIDALARAVIRGEYGDGNERRTKLGANFDAVQKRVNELLK

SEQ ID NO: 128 - protein, 314 aa, unidentified
  REGION 1..314: note = Thermophilibacter provencensis
MAYSILFKQCGSDHMTRGRSHAIDRIVVHFTATLASARNNATYFSRNEGQGASAHYFVDDISPEIYQSVAEGDTAWHAGNWLMNCRAVGIEVVSAGEDFSATEIQKLAWLVRKLMAKYGIGASGIIRHYDVTGKLCPAPYVAASKWAALKAAITGGGSSGGTTSAAPGGTVAELARRVIAGEFGNGDARRAALGSRYDEVQAEVNRILAGGSGGGAAQAPAADDVDDLARRVIAGEFGNGAARKAALGSRYAEVQARVNEMLGAGGSGGPSGGADVDALAHAVIRGDYGNGAERKRRLGSLYDAVQARVNEILS

SEQ ID NO: 129 - protein, 258 aa, unidentified
  REGION 1..258: note = Propionimicrobium lymphophilum
MSYNFHTQYNSPNYGQIYGPIALPCRRLTIHHWDDPARNPQPMSVINGLCNPNRGASAHAVVWPGNVACIVDYDKAAWHAGNATGNQSSIGLELDPCHVDATIETVAEYIADLIRQGVLARDFEIYGHKDWSSTACPGAYYGRLAEIKAKALARVDGKPAPAIKPSSSSSNLDQLADDVLTGKYGNGDERRRRLGASYDAVQARVNQMLSVKSSAPNIDQLADDVINGKYGNGDERRRRLGASYDAVQARVNQKLGVR

SEQ ID NO: 130 - protein, 303 aa, unidentified
  source 1..303: note = Parolsenella sp.
MNIAEFIQCHASNFTKGRGGNAIDGMAVHYTATSASAHNNLVYFSRAGANASAHLFVDKDGTIRQSVRFEDTAWAVGNFPQNQRTVSVEVVSAGEDFTDAQINALAQIYEYLRATYGITRVIRHYDVTGKHCPAPYVNSGKWAALKARITGGSSSSAPSGGSAPSGSATDLAKRVIAGEFGNGDARKAALGSRYDEVQAEVNRILNGGGSSSPSVDIDQMARDVIAGKYGNGDARKAALGSNYDAVQARVNELLGAGGSATGGADIDALARAVIRGEYGNGEERKRRLGSMYEAVQARVNELL

SEQ ID NO: 131 - protein, 316 aa, unidentified
  REGION 1..316: note = Collinsella sp. An271
MNIVEFIQASGANYTAGRGGRAIDGMAVHYTATSASAHNNLVYFSRPGAGASAHLFVDKDGAIRQSVRLEDTAWAVGDFAENQRTVSVEVVSAGEDFTDAQVAALAEIYAYLRATYGITRVIRHYDVTGKRCPAPYVDAGKWAALRARITGGGFGAAAGGGNGGSAPSGSVAELAQAVIRGDYGNGDARRGALGSRYDEVQAEVNRILGGGSASGGSSSGGSGADIEALAQAVIRGDYGNGDARRAALGASYDAVQARVNEILGAGGSSSGGSGGADIEALAQAVIRGEYGNGDERRHRLGSLYDAVQARVNEILL

SEQ ID NO: 132 - protein, 544 aa, unidentified
  source 1..544: note = Eggerthellaceae bacterium
MGLNGIDISSWQDDLIVSNMGTCDFVIVKATGGAGYSNECFRRHADETLAAGKLLGCYHYARDRGYEGSAEAEADHFIDAFKPYIGKAIPFLDWEADALDLGPSWAKRWLDRVKSKTGVTPGIYTSKSVLFSYDWSSVAKAYPLWVAQYPNYEDMGFTSEPWTDGWDFGAWGSPLIFQYTGTGRIPGYGGHLDLDLFYGTHDDWRRLCAVAGASAGTEEDTVSISRANVAAQIMEHLCSCPEHGYSQPGRHGTSGHCSVNTDAGTIKVTKGDRDCSSAVCEAWELSLTGSPYDGLITRYNWTGGMREMFVGSGLFSWEPMSFNASRGDIYLDEENHTAMCIRNDGTADLLGEFSISETGGIDGEPGDQTGRESWVHDYYSGSWDGILHYNGMADVGGAPGGSGSGAPSGDVSELAERVIAGEFGNGDARRAALGSRYDEVQAEVNRILLGGGSGIDVDAMARRVIAGEFGNGDERKRRLGSNYDAVQRRVNEILLGAGSSSTSMDIDAMARAVIRGDYGNGEERRRRLGSYYSIVQSRVNEMLS

SEQ ID NO: 133 - protein, 269 aa, Bifidobacterium dentium
MASVAEFIQCDSRNYTAGRQGNRIRKIVVHYTGTEASAHNNLLYFSRSSAGASAHYFIDKDGTLRQLVSEGDTAWHAGHWATNLCSVGIEVVSGGADFTEAQINTLATLVADIRSRCGVSADDVIRHYDVTGKLCPAPYVDGSKWAALHERICGGAASSGGGSGSGGSGGGPAPSGDVSELARRVINGEFGNGDVRKAALGSSYSAVQTRVNEMLGCGSSGGGSGSAGVDIDALARAVINGDYGNGEERRQRLGANYAAVQRRVNEMLS

SEQ ID NO: 134 - protein, 91 aa, Eggerthella sinensis
MRRGRARAPCDRRGVRQRGGPSRRLRRGLEAVQARVNEILGCGPSASGAASNVDALAHAVINGDYGNGEARRERLGADYEAVQRRVNELLA

SEQ ID NO: 135 - protein, 278 aa, Corynebacterium caspium
MSYAFSANIMAPGHTKGRSGYQIKYIVIHHWDDPKKNPTFNGTVSWLASKQAGTSAHYVVEAGRVALMVSEADTAWHAGDWVINCESIGIECNPRASEADKRTIGELINDIQGRHGNRLKIIGHMDVYPTACPGRYYPPSVVLEPYISGANAVIDTIDDLSIDKLADAVISGKYGSGAERRTRLGQRYDAVQQRVNEKLAKAKLSSSAENPERKAPPKPVPAENSGKDSVVGTSPTGDLEELAAAVIQGKYGNGAERRARLGDRYQEVQNLVNRKLSS

SEQ ID NO: 136 - protein, 547 aa, Olsenella sp.
MGLNGIDISSWQDDLVVSAMTTCDFVIVKATGGAGYANECFRRHADETLAAGKLLGCYHYARDRGYEGSAEAEADWFIQAFKPYVGKAIPFLDWEADALGLGPSWAKKWLDRVREKTGVTPGIYTSKSVCFSYDWAAVAKTYPLWVAQYPNYEDTGFLDEPWTDGWDFVAWDSPLIFQYTGTGRITGYGGHLDLDLFYGTRDDWRRLCAVAGVSAVTEEVKEVAISRANVAAQIMEHLCNCAEHGYSQPGRHGTSGHCNVQTDAGTIRVTKGDRDCSSAVCEAWELALAGSPYDGLITRYNWTGGMREMFVGSGLFSWKPMSFNAQRGDIYLDESSHTAMCVRNDGTADLLAEFSISETGGIDGEPGDQTGRESWVHDYYSGRWDGILHYNGKADVGSASTPTGSGAPSGDVSELAARVIAGDFGNGDARRAALGSRYDEVQAEVNRILSGGSSSGSYDVDALARRVIAGEFGNGDDRKRRLGDRYSTVQKRVNEILGASGASSTSMDVDAMARAVIRGDYGNGEERRRRLGSYYSIVQRRVNEMLS

SEQ ID NO: 137 - protein, 251 aa, unidentified
  REGION 1..251: note = uncultured Varibaculum sp.
YQTQYDSPNYQKGRPAGAPAFIVIHHWGNDGGSHQGVVNWLCRPGGNSSAHYVVSDGLVTCIVDPDNRAWHAGSGGNPRGIGIECRPECSDGDFRTVAELIADLRGTYGNLPLKGHRDFMATGCPGRWYSRLGELSRLADQIRGGKAPARPASQPAANSSGSSNLEALADAVIAGKYGNGEARRKALGANYAAVQAIVNRKLGAGGSTSVDLNALADAVIRGDYGNGQERKRRLGANYAAVQALVNKKLGY

SEQ ID NO: 138 - protein, 214 aa, unidentified
  REGION 1..214: note = Actinotignum urinale
MLNWFCNSAPTSAHYVVEAGRVACLVSCADTAYHAGNWGMNLRSIGIECNPRASEADKATVGELIADLQATYGNLRIIGHKDVKNTGCPGRYYPPAQILAPYIKQGGGAVASQPAPVPSTGGVDINALADAVLRGEYGNGAERRARLGGLYDAVQAVVNQKLGATGATRGAGVDINALADGVLKGLYGNGAERRQRLGVHYDAVQAEVNRRLGY

SEQ ID NO: 139 - protein, 118 aa, Arcanobacterium sp.
MHHRPYLGGNAGVPSAHKPPAASAPGGSVDELARAVLAGRYGNGEERKRRLGARYGEVQRRVNELIAGKAPAPSAPNLDALANAVLRGEYGNGEERRRRLGSLYQPVQDLVNRKLGIR

SEQ ID NO: 140 - protein, 252 aa, unidentified
  REGION 1..252: note = Caudoviricetes sp.
MSYQQSFIPANPSNYTKGRGGKRITTIVIHHWDDPAKNPQLSGVIATFQNPGRGASAHFVVEAGRVVQMVDLANTAWHAGNWPINQCSIGIECNPRCSDADKATIGELIRNLQATYRPLKIIGHKDASSTACPGRYYPPASVLGPYITGGGSPAAPAPSVGGDIEALAQAVICGEYGNGEDRKARLGHLYDAVQARVNAKLSGSAPAPAPGPNLDALADAVIRGDYGNGAERRNRLGHLYDAVQAIVNRKLS

SEQ ID NO: 141 - protein, 257 aa, Bifidobacterium scardovii
MSYQDITQYNSPNYTAGRPYGIACIVIHWWDDPARHPTFYGVISTLCSPARRASANYVAEAGRVACLVDPDNRSWASGDGVNCNSMGNDRGISIECNPRQSDGDYETIGELVRNLRNAYGDLPLRRHRDFAQTDCPGTYDLDRIDRIARGGASAPAAKPQQSTPAVNIDDLARRAIAGEFGNGDERKAKLGGNYAAVQQRVNEMLGQGGGSSAPSVDLNALADAVIRGDYGNGEERKRRLGGNYAAVQQLVNRKLGY

SEQ ID NO: 142 - protein, 190 aa, Bifidobacterium pseudocatenulatum
MVAESDTAWHAGNWPVNQTSIGIECNPRASEADKQTVAALIRDIQSRHGKLRIIGHKDASSTACPGRYYPPTVTLAPYLGSNGGVPAAVKPPAPTAAGGSVDELARAVIAGKYGNGDERRRRLGNRYGEVQARVNELISGKKPAPKPANLDAIANAVLRGEYGNGDERRRRLGNLYQPVQDLVNRKLGIR

SEQ ID NO: 143 - protein, 88 aa, unidentified
  REGION 1..88: note = Muribaculaceae bacterium
MKSLILSCICVVLTLGLASCSPKQSATKQPVDAVSSTTTATDIEEKAKSVIRGEFGNGQERKKRLGSDYSEVQKKVNEIYSKGKSKSK

SEQ ID NO: 144 - protein, 333 aa, unidentified
  REGION 1..333: note = Caudoviricetes sp.
MHGIDIASHQTGIDLSKVPCDFVICKATGGTGYISPDFKRQIEQALAEGKCVGAYHFALDGFAGTTPEGEAQHFLNAVEPYLGKVILALDWEAKAVKLGAGWAKRWLDYVYNKTGIRAMIYMSKGRANSKVWAEVAKNHPLWVTQYAISTDKNYKAGYTPVRGYLSNPPGEKSVGPWGTNITIRQYTSMGFLDGWPRRLDLDLAYIDRAGWDKLCGKTAAPVEPEAPAKPTIDELAQEVLTGKWGNGSERKQRLEAAGHDYAAVQRRVNEILSGNAPGEPTTPPTSEELTAAEIDALARAVIRGDYGNGVTRRAKLGSKYAAVQKRVNEILRG

SEQ ID NO: 145 - protein, 369 aa, unidentified
  REGION 1..369: note = Arthrobacter phage Gordon
MTFSSLISGTIPHNNKFSSRQGVPVSRIIQHHFAGSSDERLRSATEQASSHYVIYNDGSIWGLVPEEYRAWTSGSFEADAPSITYEVQNSSFQINGNDDDPNSWAVSDAAYNSIVLLTADIARRYGFGAVTPTNYQGHRQWYSTACPGGFLWARMDNTRSLANKNLSGATVPTPTPSTPPVAGKTVWQLADEVLAGHHGSGDDRKISLGIQYDAVQAEINRRYGVVVVAPAEKTVSQLADEVLAGAHGNGEQRRASLGNRFDEVQNEINRRLGGGGVAPQGLNIAQLADAVMRGEYGSGQDRINRLGANYDAVQQEVNRRLGGNASPVANINALADAVLRGEYGNGDERVRRLGANYAAVQAEINRRYA

SEQ ID NO: 146 - protein, 347 aa, unidentified
  REGION 1..347: note = Lederbergia galactosidilytica
MAGLLNIPKLVDFRNKVKRHPSLEFPVLSLKGKTTIAVHHSLTKQGLAGSNAEGYARYHVDTLGWPSIGYSYVIEPDGTIKFCNDIELRTYHVGDHNNYAVGICLTGDFRTEKPTKAQEESLRNLVFGLQKAYPHLKFVKGHNEFSGYEWKACPCFDYKAILANKTISKPIENKVSGVSTSKPSKPKSKSIDQLADEVIKGLHGSGAQRKNSLGSQYDAVQKRVNEKLLGSQPKPKPATKSIDQLVKETLAGKHGNGEARKKSLGKNYKAVQDIINGKSSAPKKTDSKPKTLKVGQKVKIKSSAKKYATGQTIPSQYKNKTYTIQQVKSDRVLIKELYSWVKKSDVQ

SEQ ID NO: 147 - protein, 374 aa, unidentified
  REGION 1..374: note = Arthrobacter phage Makai
MTFSSLISGTIPHNNKYSSRQGVPVSRIIQHHFAGFSDGRLRSATEQASSHYVIYNDGSIWGLVPEEFRAWTSGSFEADAPAITYEVQNSSLQINGNDNDAGSWAVSPAAYNAIVRLTADIARRHGFGAVTPTNYQGHRQWYPTACPGGYLWARMDNTRSLANKALTGAVAPAATPATPPTKGKTVWQLADEVLAGHHGSGDARKASLGAQYDAVQAEVNRRLGAGTAAPKVKTISQLADEVIAGKHGTGAARQKSLGNQYTAVQNEINRRLGGGGVAPQGVNISALADRVLRGEFGSGDARVKALGKNYAAVQAEVNRRLGGGKAASAPKRVVNISALADAVIRGEYGSGEDRKRRLGANYAAVQAEVNRRYS

SEQ ID NO: 148 - protein, 300 aa, unidentified
  REGION 1..300: note = Paludibacteraceae bacterium
MSYTLENSIRATAFTRGRAGHSIQYIIIHHWGDPAQNPQFDSIVSYFARGGNKTSAHYIVEAGRVAQMVSDSDTAYAAGNWPMNLKSINLECNPRASDEDKKTICELIANLRAVHGNVPIIGHQDVVPTDCPGRYYPPNQTLAPWLGSSASTPAAPPSGDLNALADAVLRGEYGNGDERKRRLGSNYAAVQAIVNQKLGAGSAPAPAPAAPAVDLNALADAVIRGEYGNGDDRRNRLGANYDAVQNLVNRKLQGAPAAGPDLNALADAVIRGEYGNGDERKRRLGANYAAVQALVNRKLR

SEQ ID NO: 149 - protein, 152 aa, unidentified
  REGION 1..152: note = Porphyromonadaceae bacterium
TGKPMRMTWIWICSIIVLVVIVIACIRGCDSAEKTAQQPQQAEQIQAPAPCDESENDASDQAATETEAADSVAADAAASAASAEAAATPYEPQQPQTEPSPAVTPSASPSIDLEAEAAKVIRGDYGNGDERRARLGDNYRAVQNVVNRMLAQ

SEQ ID NO: 150 - protein, 333 aa, unidentified
  REGION 1..333: note = Candidatus Colimorpha merdihippi
MTKLYVIAGHGGGDTGACGNGYQEHERVVALAQEIVARGGGEVDHWPYDQDCYGSGGMDWINPGCPVLELHMDSASPGARGGHVIIPSNCGGADGYDNAIADLMREVFPGRSNLIVERGDLRNPNVARQRGINYRLVENGFISDAGDVATFNANIGYLADRYLAIFGIGSGGGSAPAPAPTPAPAPTPSGSIDDLAQRVINGEFGNGDARKAALGDKYDAVQARVNEMLGVGGGSHAPSPTPATDIDDLARRVINGEFGNGDARKAALGSKYDAVQARVNEMLGCGGGGGSTSVDIDTLAWKVINGDYGNGQARRDALGDLYDRVQARVNELL

SEQ ID NO: 151 - protein, 204 aa, unidentified
  REGION 1..204: note = Muribaculaceae bacterium
MTNDEMKRNARKAADEVQGRIEQGPPQEQISDHSEVYDDMPEYEAADQLIDDSRKAAGKRGWMWIAVAIALILGAAICVLMIPELTGTKTGDALATAKATVSNGLDKVSNAASSGVAVIEETVGTVQEGVSDAAAGAVSNAKAKVSGAVGNAAAAASTDVSAATIDAEARRVIHGDFGNGAQRKAALGSHYAAVQQRVNELLHV

SEQ ID NO: 152 - protein, 283 aa, Chlamydia trachomatis
MKNWDTLEADIDLILDKHYTSGRGGREINKIIVHHNAGRLSIQECWNVWQTREASAHYQVEEDGTIGQLVRDRNTAWHAGNWDANTTSIGIEHANNHIGEPWTISEATLDNGAHLVAALCVFYKLGEPHWGVNVFPHRQFSATACPGEIAGSQNAAYMQRARYWYNTMTGNTSATVPVTPSELDATNSTSIEELAREVIRGTWGNGNERYQRLTAAGFDYDAVQARVNELVGIASKPANKNIDRLAREVIRGDWGNGQERYNRLTAAGYDYHTVQARVNQLLA

SEQ ID NO: 153 - protein, 312 aa, unidentified
  source 1..312: note = Murdochiella vaginalis
MSKGIDVSKWNGSIDFNKVKADGIDFVIIRAGYGWDTSQKDRTFEQNYARAKAAGLHVGAYWYSYARSADNARSEAKVCKQIIAGKQFDYPIFFDLEESSQLSRGQAFCDSLIQAFCNEMEAGGYFAGFYTSASVARNILSKSIRKRYAFWCAQWANTNSFEGESGLWQYSSKGSVSGIAGNVDLDISYIDYPSLIRGGGFNGYAKGSTAPTAKPAPAPEKKTVETLADEVIKGLWGNGEERKRRLTASGYSYDAVQKKVNERLSVKPKKSINTLAREVIHGDWGNGNERKNRLTKAGYNYDAVQKRVNELL

SEQ ID NO: 154 - protein, 317 aa, unidentified
  REGION 1..317: note = Oceanobacillus sp. J11TS1
MAGIVNVPKFVDFRNKVKRHPTRKFPVLSLKGKTTIAIHHSLTRQGLGGSNAESYAKFHVDTHGWPSIGYSYVIEPDGTIKFCNDIELRTYHVGDHNNYAVGICLTGDFRYEEPTNAQKESLRNLVNALQTKYPHLKHIKGHNEFSGYEWKECPVFDYKTVLDNKSISKSTSTSDKPKTDGKSIDQLADEVIAGKHGYGDARKKALGSQYDAVQKRVNEKLGSKPKKSSKSIDTLVKETLAGKHGNGEARKKSLGSNYEAVMDVINGKASKPKKSVSQMATEVIQGKHGFGHENRRKSLGISKTEYEKVRKEVNKRL

SEQ ID NO: 155 - protein, 217 aa, Gracilibacillus saliphilus
ADYLVSVHINGGGGRGYEDFIYNGGVSEATKANQNIMNAELINATGFDNRGKKQANFHMVRESRMPAILTESGFIDDSKDARNLKSNSFLDKVAQGHVNGLVKIFGLKKTSNNSSNSKKKPSKNKSIDQLAQEVIAGKYGTGASRKKALGSQYDAVQKRVNEILLGDKPKSSGKSINQMATEVIQGKHGNGHANRRKSLGISQSEYEKVRSEVNRRL

SEQ ID NO: 156 - protein, 328 aa, Enterococcus faecalis
MSNSRLVDMTMLSPNHSGRRNQSITKIAIHHTAGAVSAATIGQIFKPTSRQASCNYGIGNDNKIVLCVDESNRSWCTSSSWCDNRAVTIEVSNSANGGNWPVSDRVLATLIDLVTDICRRNGIKNCTYTGGKDGVLQKHEWYAATNCPGPYLGSKFSYIANEVNKRLVGDSSNVPSTGSSSLYRVRKSWSDAKSQKGAFRNLDNAKKCANANSGYSVYDANGNSVYPVESAPSKSVDTLAREVIAGNWGNGQDRVNRLTSAGYNYNSVQNRVNEILSGVSNKPSGKSIDTLAREVIRGDWGNGQDRKNRLERAGYDYDAVQKRVNELL

SEQ ID NO: 157 - protein, 329 aa, unidentified
  REGION 1..329: note = Peptostreptococcus equinus
MSNSSLVNYVRLSPNHSGRRNHKIDTITIHHMAGNLSVETCGSVFAASSRGASSNYGVDSNGRVGMYVEECNRSWCSSSSANDNRAVTIEVANDQIGGNWHVSDRALAKTIELCVDICKRNGIKRFNYTGDTRGNLTKHCWFAATNCPGPYLGSKFPYIASEVNKRLSGSGSSSSGTNPSYLYRVRKSWGDAKSQKGAFRNLDNAKKCANANPGYSVYDANGRSVYPVASTPSKSIDALAREVIAGNWGNGQYRVNRLRSAGYDYDAVQNRVNEILSGKSSSQSGGKSIDTLAREVIRGDWGNGQDRKNSLERAGYDYNAVQRRVNELL

SEQ ID NO: 158 - protein, 246 aa, Clostridium sp.
MKIIDKGLQFNSNHSSMKKVEGIGLHHSGVTVLQSVEVIHNYHKSKGWAGIGYHYYVRKDGSIYRGRPENMAGAHCTGINSISIGICAEGNFSEETMSNVQKQALIELVKDIKSRYDIKWVRGHKEILSTSCPGTNFPLEEIKNVIANVETPQITDSIEDLANEVIAGKYGNGEERKQKLGSSYDEVQRRVNEILLGKDSSTNTNEELAKEVIEGKWGNNPERKQRLLEAGYDYEAIQKIVNQRLK

SEQ ID NO: 159 - protein, 308 aa, unidentified
  REGION 1..308: note = Oscillospiraceae bacterium
MTRGIDVSRWQGDFDFEAALNEGWEFAVLKGGGGDDGLYVDGRFEENYNKTKKLKIPVGCYFFGYAKNGDEAKKEAEYFYENCLKGKKFELPVFIDVEGDMLKAPKEELTKTVKIWCETLEKKGFFVGIYASLSVFCNNLDDKELLKFTHWVARWAYDCGYKNKDALCMWQFGGNTNLLRSNKVAGVVCDQNYMFIDFESTIKRLGLNGFEKTDGEKADIDKIAREVIRGEWGNGEERKERLKKAGYSYEEVQNRVNELLSEDKKSIDEIANEVIRGEWGNGEERKKRLRDAGYDYDAVQKRVNEKIG

SEQ ID NO: 160 - protein, 333 aa, unidentified
  REGION 1..333: note = Clostridiales bacterium
MSKKVFLSPSNQYDNRYAYGNTTEGVQCGKIAEACKAALQRSGIEVMLMHDESMQEKCQKSDAFGADIHVPIHTNAANGNVSGTRMFCYSASGEGMKACKAIFDVLAPVTPGTSENIKVDTSLYEIRVPNAPTTYIEVDFHDNPTAAKWIVENTTLIGETIAKGVCNYFGITYKAGGFTPSPKPVSGELYRVRKSWADAASQIGAFAVLENAIKVCKTGYSVFDSKGNVVYPKAQPAPTKKSVDEIAREVIRGDWGNGSDRTKRLSAAGYDANAVQNRVNEILGGSSTPKKSIDEVAHEVIRGEWGNGADRKNRLIAAGYNYDAVQKRVNEIL

SEQ ID NO: 161 - protein, 323 aa, unidentified
  REGION 1..323: note = Ruminococcus sp. FC2018
MTKSGIDVSQWQGAINWAQVKGKVDFALIRAGYGNTLSFPYQIDNQYEANYKGCKAAGIPVGVYFYSYAATAAEAEREADSCIALLKGKQFEYPVYYDVEEFDIFRSGNTNAIITAFCDKLEKAGYFVGIYIYRSALQTYVSKQIRERYAIAVAEYGPSCNYDGPYGIWQNTSDWSCSGISGRVDHDYCYVDYPGIIKEAGRNGFSKTVPTVKPTPAPAPKPEPAKKSVDEIAREVIAGKWGAGEERKKLLTSAGYDYNAVQNKVNEILYDPKPQPPKKSIDQIAREVIRGDWGAGEERRKRLTAAGYDYDAVQKRVNEILYG

SEQ ID NO: 162 - protein, 300 aa, unidentified
  REGION 1..300: note = Oscillospiraceae bacterium
MSITLKGIDVSGYQGEIDFERVKESGVEFVIVKAGYSTSTVPTWEKNFANAKNSGLKVGAYWYSYARTIEDGIREAKAFIKALDGKQLDFPVYMDLEERAQFNLGKEFCTELVKAFCGELAKAGYYCGVYSTTYWYTTYVDEKIREAYPAWIADYRDKCYYTGTYGIWQYGTGTVPGVQYECDLDEGYDDYSKYIIENGLNGYPKKPEKTLDELARDVIRGDWGNGEERYERLTEAGYDYDAVQKRVNEILYPPLKPLDEVAREVIRGDWGNGEERYRRLTEAGYDYYQVQRKVNEILYN

SEQ ID NO: 163 - protein, 528 aa, unidentified
  REGION 1..528: note = uncultured Catenibacterium sp.
MLDANKQKFVDDIANCVKKYASSYGISVNSPIIAQAILESGWGKSKLAFDYHNYFGMKCGTKWTGPSVNMTTQEEYEVGTLTTIKDNFRVYDSMENGVKGYFEFIQLSRYENLKGITDPKTYLETIKADGYATSSTYVDSLMQIIKLYNLTSYDNAENAGNGGNEMGSRQAMVAKMQSWIGKNEADGSFREVIDIYNSHTPRARGYKLQYSDEWCAGTVSAAAIATGNTDAVPLEVSCHYMIEGAKAKGIWVENDGYVPQGGDIILYDWQDSGAGDNTGNPDHVGVVEYTSGGVIHVIEGNKGRKVARRELSVNGRYIRGFIVPKYSSDTAPGGGSTPSVSGTIDELARRVIAGEFGSGDTRKNALGDKYGAVQARVNEILNGTASAPAKKSVSEIAKEVLAGAWGNGDARKQKLEAAGYNYSEVQAKVNSLASGSSSSVDIDALARRVIAGEFGSGDARKKALGSNYDAVQKRVNEMLGGSSSSVNYAAIAKEVINGKWGNGAARKKKLEAAGYNYNKVQKEVNKLL

SEQ ID NO: 164 - protein, 322 aa, unidentified
  REGION 1..322: note = Anaerolactibacter massiliensis
MSNSSLVVYRDMTSGHWNDRAGNKISRIVIHHQAGNLSLQTLGNVFKNRQASAHYGIDSNGRIGQYVDEAYRAWTTSGWEPDRNTVTIEVANSQAGGNWPISDAAMSSLIKLCADICKRNGISRLYYNGKNGTLLRHCDYSATSCPGPYIKEHTNYICDQVNALLGTGSAASTQPNAATGSIDDLAKRTIAGEFGNGDQRRAALGANYDAVQARVNEILGGGSSSQPAVFDVDAAARDVIAGKYGNGDQRRTALGSHYDEVQARVNQMLGAAASTSVNIDAEARKVIRGDYGNGGERRNALVAKFGANVANQIQTRVNDLLR

SEQ ID NO: 165 - protein, 332 aa, unidentified
  REGION 1..332: note = Amedibacterium intestinale
MSNSNMVSYTKLSPNHSGRRTHSIDRITPHCVVGQCSVETLGNIFAPTSREASCNYGIGVDGRIGMYVEEKNRSWCSSSNANDQRAVTIECASDTYHPYAMNSKVYDTLIKLCVDICRRNGKKKLLWFGDKNKSLNYSPKSDEMVLTVHKWFANKSCPGDWLYSRLGDLAKRVTAELGGPVSSSTSGLYRVRKSWTDSKSQVGAFSVFENAEKCADSHKGYSVYDEQGVLIYPKTNNKSIDELAREVINGLWGNGSDRKNKLISASYDYDAVQNRVNEILDGGKATPSKSIDTLAKEVIRGDWGNGADRKKRLTAAGYNYDAVQKRVNQILG

SEQ ID NO: 166 - protein, 108 aa, synthetic construct
APTPPAKPTPPAPKPSVNIDALADAVIRGEYGNGDERKRRLGSNYAAVQKRVNEKLAGRSPAKPSVNIDALADAVIRGDYGNGEERKHRLGGNYAAVQKRVNEKLGIG

SEQ ID NO: 167 - protein, 108 aa, synthetic construct
APTPPAKPTPPAPKPSANIDALADAVIRGEYGNGDERKRRLGSNYAAVQKRVNEKLAGGSPAKPSVNIDALTDAVIRGEYGNGEERKRRLGGNYAAVQKRVNEQLGIS

SEQ ID NO: 168 - protein, 108 aa, synthetic construct
APTPPAKPTPPTPKPSANIDALADAVIRGEYGNGDERKRRLGSNYAAVQKRVNEKLAGGSPAKPSVNIDALADAVIRGDYGNVEERKRRLGANYAAVQKRVNEKLGIG

SEQ ID NO: 169 - protein, 106 aa, synthetic construct
PVPKQPAKSAPTPAPSVNIDALADAVIRGEYGNGNERKRRLGANYAAVQKRVNEKLAGNTSKPSVNIDALADAVIRGEYGNGEERKRRLGANYAVVQARVNQKLGY

SEQ ID NO: 170 - protein, 109 aa, synthetic construct
QKPAEPAPAPAPAPARKDIDTVAREVIAGQWGNNPQRAEKLRAAGYDANAVQARVNQMLGAPAPKPAANIDALADAVIRGDYGNGDERRRRLGANYDAVQRRVNQKLGL

SEQ ID NO: 171 - protein, 109 aa, synthetic construct
TPAKPTPTPKPAPSVPPNIDALADAVIRGEYGNGEERKRRLGANYTAVQRRVNEKLAGKKPAAKPSGPNIDALADAVIRGEYGNGEERKRRLGNLYDQVQKRVNQKLGY

SEQ ID NO: 172 - protein, 107 aa, synthetic construct
TGTTPTPKPQPTPTPAANIDALADAVIRGDYGNGNERKRRLGANYAAVQKRVNEKLAGGSPSKPSANIDALADSVIRGDYGNGDERRRRLGENYVAVQARVNQKLGY

SEQ ID NO: 173 - protein, 108 aa, synthetic construct
APTPPAKPTPPAPKPSANIDALADAVIRGEYGNGEERKRRLGANYTAVQKRVNEKLTGGSPAKPSANIDALADAVIRGEYGNGEERKRRLGGNYAAVQKRVNEKLGIG

SEQ ID NO: 174 - protein, 106 aa, synthetic construct
TGTTPTPKPQPAPAPAPNIDALADAVIRGDYGNGNERKRHLGANYAAVQKRVNEKLAGNTSKPSVNIDALADAVIRGEYGNGEERKRRLGANYDAVQARVNQKLGY

SEQ ID NO: 175 - protein, 107 aa, synthetic construct
SGKTPAPTAKSASTPSTDIDALADAVIRGEYGNGGERKQRLGANYTAVQKRVNEKLSGAAPAKPDGPNIDALADAVIRGEYGNGDERKQRLGNLYSAVQARVNQKLG

SEQ ID NO: 176 - protein, 109 aa, synthetic construct
MTGNTPAPAPAPAPAAPNIDALADAVIRGEYGNGDERKRRLGANYAAVQQRVNEKLLGNAPATKPAGPNIDALADAVIRGEYGNGEERKRRLGNLYGAVQARVNVKLGY

SEQ ID NO: 177 - protein, 108 aa, synthetic construct
SGTKPAPAPKPTPAPTPNIDALADAVIRGEYGNGDERRRRLGNLYDQVQRRVNEKLAGKKPAPKPAPNIDALADAVIRGEYGNGDERRRRLGSLYDQVQRRVNQKLGY

SEQ ID NO: 178 - protein, 110 aa, synthetic construct
APTPPAKPTPPAPKPSVNIDALADAVIRGEYGNGEERKRKRRLGSNYAAVQKRVNEKLTGGNPNKPSVNIDALADAVIRGDYGNGEERKRRLGGNYAAVQKRVNEKLGIS

SEQ ID NO: 179 - protein, 108 aa, synthetic construct
DQMTGTKPAPAPAAPSVNIDTFADAVIRGEYGNGDERKRRLGANYAAVQARVNEKLAGKAKPAGKSIETLAREVIRGDWGNGQERYNRLTNAGYNYQQVQNRVNQILN

SEQ ID NO: 180 - protein, 106 aa, synthetic construct
YDQISGNKPQAASASKPDIEALANAVIRGEYGNGDQRRARLGGLYDAVQRRVNEKLAAGSAPAAPNIDALADAVIRGDYGNGATRRARLGNLYNQVQARVNQKLGC

SEQ ID NO: 181 - protein, 164 aa, synthetic construct
KTAAAASVSKPAASKGPNYEALADAVIRGEYGSGEERMRRLGNAYARVQAIVNARLLGGQPTPTPLPAKPAGANIDALAKAVIRGEYGTGDARRQKLGNLYDQVQARVNQILGAGATAHRAGANIDALADAVIRGEYGNGDERRVRLGANFAAVQARVNQKLAA

SEQ ID NO: 182 - protein, 109 aa, synthetic construct
PAPAKPSPAKPAPSTPPNIDALADAVIHGDYGNGEERKRRLGSNHAAVQKRVNEKLAGKKPAVKPAGPNIDALADAVIRGGYGNGDERKRRLGGLYAQVQKRVNQKLGY

SEQ ID NO: 183 - protein, 107 aa, synthetic construct
GAGGAASASPAPTVPSPDIDALAREVIAGKYGNGDDRRRALGANYGRVQARVNEILGAGARPHSQVVDVDALARAVIRGEFGNGEERKRRLGANYAAVQRRVNELLS

SEQ ID NO: 184 - protein, 108 aa, synthetic construct
GGGGNGRSASGVDSPSGDLNALADAVLRGDYGNGDERKRRLGSKYSAVQAIVNQRLGYGSTPVSSGPDLNALADAVIRGEYGNGDERRRRLGANYKAVQALVNKKLGY

SEQ ID NO: 185 - protein, 138 aa, synthetic construct
ERVETGVAAENCPDGSTANLAAAVMRGEYGNGDERRKRLGSRYDEVQALINRVSSSSVDDLAKDVLNGVFGNGDTRRAVLGSRYDEVQARVNARSSSVDIDALARAVIRGEYGDGNERRTKLGANFDAVQKRVNELLK

SEQ ID NO: 186 - protein, 161 aa, synthetic construct
TGGGSSGGTTSAAPGGTVAELARRVIAGEFGNGDARRAALGSRYDEVQAEVNRILAGGSGGGAAQAPAADDVDDLARRVIAGEFGNGAARKAALGSRYAEVQARVNEMLGAGGSGGPSGGADVDALAHAVIRGDYGNGAERKRRLGSLYDAVQARVNEILS

SEQ ID NO: 187 - protein, 105 aa, synthetic construct
RVDGKPAPAIKPSSSSSNLDQLADDVLTGKYGNGDERRRRLGASYDAVQARVNQMLSVKSSAPNIDQLADDVINGKYGNGDERRRRLGASYDAVQARVNQKLGVR

SEQ ID NO: 188 - protein, 153 aa, synthetic construct
GGSSSSAPSGGSAPSGSATDLAKRVIAGEFGNGDARKAALGSRYDEVQAEVNRILNGGGSSSPSVDIDQMARDVIAGKYGNGDARKAALGSNYDAVQARVNELLGAGGSATGGADIDALARAVIRGEYGNGEERKRRLGSMYEAVQARVNELL

SEQ ID NO: 189 - protein, 163 aa, synthetic construct
FGAAAGGGNGGSAPSGSVAELAQAVIRGDYGNGDARRGALGSRYDEVQAEVNRILGGGSASGGSSSGGSGADIEALAQAVIRGDYGNGDARRAALGASYDAVQARVNEILGAGGSSSGGSGGADIEALAQAVIRGEYGNGDERRHRLGSLYDAVQARVNEILL

SEQ ID NO: 190 - protein, 151 aa, synthetic construct
DVGGAPGGSGSGAPSGDVSELAERVIAGEFGNGDARRAALGSRYDEVQAEVNRILLGGGSGIDVDAMARRVIAGEFGNGDERKRRLGSNYDAVQRRVNEILLGAGSSSTSMDIDAMARAVIRGDYGNGEERRRRLGSYYSIVQSRVNEMLS

SEQ ID NO: 191 - protein, 109 aa, synthetic construct
GGSGSGGSGGGPAPSGDVSELARRVINGEFGNGDVRKAALGSSYSAVQTRVNEMLGCGSSGGGSGSAGVDIDALARAVINGDYGNGEERRQRLGANYAAVQRRVNEMLS

SEQ ID NO: 192 - protein, 57 aa, synthetic construct
RVNEILGCGPSASGAASNVDALAHAVINGDYGNGEARRERLGADYEAVQRRVNELLA

SEQ ID NO: 193 - protein, 135 aa, synthetic construct
EPYISGANAVIDTIDDLSIDKLADAVISGKYGSGAERRTRLGQRYDAVQQRVNEKLAKAKLSSSAENPERKAPPKPVPAENSGKDSVVGTSPTGDLEELAAAVIQGKYGNGAERRARLGDRYQEVQNLVNRKLSS

SEQ ID NO: 194 - protein, 153 aa, synthetic construct
DVGSASTPTGSGAPSGDVSELAARVIAGDFGNGDARRAALGSRYDEVQAEVNRILSGGSSSGSYDVDALARRVIAGEFGNGDDRKRRLGDRYSTVQKRVNEILGASGASSTSMDVDAMARAVIRGDYGNGEERRRRLGSYYSIVQRRVNEMLS

SEQ ID NO: 195 - protein, 105 aa, synthetic construct
APARPASQPAANSSGSSNLEALADAVIAGKYGNGEARRKALGANYAAVQAIVNRKLGAGGSTSVDLNALADAVIRGDYGNGQERKRRLGANYAAVQALVNKKLGY

SEQ ID NO: 196 - protein, 108 aa, synthetic construct
GGAVASQPAPVPSTGGVDINALADAVLRGEYGNGAERRARLGGLYDAVQAVVNQKLGATGATRGAGVDINALADGVLKGLYGNGAERRQRLGVHYDAVQAEVNRRLGY

SEQ ID NO: 197 - protein, 108 aa, synthetic construct
AGVPSAHKPPAASAPGGSVDELARAVLAGRYGNGEERKRRLGARYGEVQRRVNELIAGKAPAPSAPNLDALANAVLRGEYGNGEERRRRLGSLYQPVQDLVNRKLGIR

SEQ ID NO: 198 - protein, 107 aa, synthetic construct
YITGGGSPAAPAPSVGGDIEALAQAVICGEYGNGEDRKARLGHLYDAVQARVNAKLSGSAPAPAPGPNLDALADAVIRGDYGNGAERRNRLGHLYDAVQAIVNRKLS

SEQ ID NO: 199 - protein, 108 aa, synthetic construct
GGASAPAAKPQQSTPAVNIDDLARRAIAGEFGNGDERKAKLGGNYAAVQQRVNEMLGQGGGSSAPSVDLNALADAVIRGDYGNGEERKRRLGGNYAAVQQLVNRKLGY

SEQ ID NO: 200 - protein, 108 aa, synthetic construct
GGVPAAVKPPAPTAAGGSVDELARAVIAGKYGNGDERRRRLGNRYGEVQARVNELISGKKPAPKPANLDAIANAVLRGEYGNGDERRRRLGNLYQPVQDLVNRKLGIR

SEQ ID NO: 201 - protein, 64 aa, synthetic construct
SATKQPVDAVSSTTTATDIEEKAKSVIRGEFGNGQERKKRLGSDYSEVQKKVNEIYSKGKSKSK

SEQ ID NO: 202 - protein, 120 aa, synthetic construct
LCGKTAAPVEPEAPAKPTIDELAQEVLTGKWGNGSERKQRLEAAGHDYAAVQRRVNEILSGNAPGEPTTPPTSEELTAAEIDALARAVIRGDYGNGVTRRAKLGSKYAAVQKRVNEILRG

SEQ ID NO: 203 - protein, 201 aa, synthetic construct
ATVPTPTPSTPPVAGKTVWQLADEVLAGHHGSGDDRKISLGIQYDAVQAEINRRYGVVVVAPAEKTVSQLADEVLAGAHGNGEQRRASLGNRFDEVQNEINRRLGGGGVAPQGLNIAQLADAVMRGEYGSGQDRINRLGANYDAVQQEVNRRLGGNASPVANINALADAVLRGEYGNGDERVRRLGANYAAVQAEINRRYA

SEQ ID NO: 204 - protein, 126 aa, synthetic construct
NKVSGVSTSKPSKPKSKSIDQLADEVIKGLHGSGAQRKNSLGSQYDAVQKRVNEKLLGSQPKPKPATKSIDQLVKETLAGKHGNGEARKKSLGKNYKAVQDIINGKSSAPKKTDSKPKTLKVGQKV

SEQ ID NO: 205 - protein, 206 aa, synthetic construct
AVAPAATPATPPTKGKTVWQLADEVLAGHHGSGDARKASLGAQYDAVQAEVNRRLGAGTAAPKVKTISQLADEVIAGKHGTGAARQKSLGNQYTAVQNEINRRLGGGGVAPQGVNISALADRVLRGEFGSGDARVKALGKNYAAVQAEVNRRLGGGKAASAPKRVVNISALADAVIRGEYGSGEDRKRRLGANYAAVQAEVNRRYS

SEQ ID NO: 206 - protein, 157 aa, synthetic construct
PWLGSSASTPAAPPSGDLNALADAVLRGEYGNGDERKRRLGSNYAAVQAIVNQKLGAGSAPAPAPAAPAVDLNALADAVIRGEYGNGDDRRNRLGANYDAVQNLVNRKLQGAPAAGPDLNALADAVIRGEYGNGDERKRRLGANYAAVQALVNRKLR

SEQ ID NO: 207 - protein, 57 aa, synthetic construct
QTEPSPAVTPSASPSIDLEAEAAKVIRGDYGNGDERRARLGDNYRAVQNVVNRMLAQ

SEQ ID NO: 208 - protein, 159 aa, synthetic construct
APAPAPTPAPAPTPSGSIDDLAQRVINGEFGNGDARKAALGDKYDAVQARVNEMLGVGGGSHAPSPTPATDIDDLARRVINGEFGNGDARKAALGSKYDAVQARVNEMLGCGGGGGSTSVDIDTLAWKVINGDYGNGQARRDALGDLYDRVQARVNELL

SEQ ID NO: 209 - protein, 57 aa, synthetic construct
AVGNAAAAASTDVSAATIDAEARRVIHGDFGNGAQRKAALGSHYAAVQQRVNELLHV

SEQ ID NO: 210 - protein, 110 aa, synthetic construct
ATVPVTPSELDATNSTSIEELAREVIRGTWGNGNERYQRLTAAGFDYDAVQARVNELVGIASKPANKNIDRLAREVIRGDWGNGQERYNRLTAAGYDYHTVQARVNQLLA

SEQ ID NO: 211 - protein, 106 aa, synthetic construct
GSTAPTAKPAPAPEKKTVETLADEVIKGLWGNGEERKRRLTASGYSYDAVQKKVNERLSVKPKKSINTLAREVIHGDWGNGNERKNRLTKAGYNYDAVQKRVNELL

SEQ ID NO: 212 - protein, 151 aa, synthetic construct
ISKSTSTSDKPKTDGKSIDQLADEVIAGKHGYGDARKKALGSQYDAVQKRVNEKLGSKPKKSSKSIDTLVKETLAGKHGNGEARKKSLGSNYEAVMDVINGKASKPKKSVSQMATEVIQGKHGFGHENRRKSLGISKTEYEKVRKEVNKRL

SEQ ID NO: 213 - protein, 108 aa, synthetic construct
TSNNSSNSKKKPSKNKSIDQLAQEVIAGKYGTGASRKKALGSQYDAVQKRVNEILLGDKPKSSGKSINQMATEVIQGKHGNGHANRRKSLGISQSEYEKVRSEVNRRL

SEQ ID NO: 214 - protein, 110 aa, synthetic construct
DANGNSVYPVESAPSKSVDTLAREVIAGNWGNGQDRVNRLTSAGYNYNSVQNRVNEILSGVSNKPSGKSIDTLAREVIRGDWGNGQDRKNRLERAGYDYDAVQKRVNELL

SEQ ID NO: 215 - protein, 111 aa, synthetic construct
DANGRSVYPVASTPSKSIDALAREVIAGNWGNGQYRVNRLRSAGYDYDAVQNRVNEILSGKSSSQSGGKSIDTLAREVIRGDWGNGQDRKNSLERAGYDYNAVQRRVNELL

SEQ ID NO: 216 - protein, 106 aa, synthetic construct
EIKNVIANVETPQITDSIEDLANEVIAGKYGNGEERKQKLGSSYDEVQRRVNEILLGKDSSTNTNEELAKEVIEGKWGNNPERKQRLLEAGYDYEAIQKIVNQRLK

SEQ ID NO: 217 - protein, 106 aa, synthetic construct
KRLGLNGFEKTDGEKADIDKIAREVIRGEWGNGEERKERLKKAGYSYEEVQNRVNELLSEDKKSIDEIANEVIRGEWGNGEERKKRLRDAGYDYDAVQKRVNEKIG

SEQ ID NO: 218 - protein, 108 aa, synthetic construct
KGNVVYPKAQPAPTKKSVDEIAREVIRGDWGNGSDRTKRLSAAGYDANAVQNRVNEILGGSSTPKKSIDEVAHEVIRGEWGNGADRKNRLIAAGYNYDAVQKRVNEIL

SEQ ID NO: 219 - protein, 112 aa, synthetic construct
VKPTPAPAPKPEPAKKSVDEIAREVIAGKWGAGEERKKLLTSAGYDYNAVQNKVNEILYDPKPQPPKKSIDQIAREVIRGDWGAGEERRKRLTAAGYDYDAVQKRVNEILYG

SEQ ID NO: 220 - protein, 107 aa, synthetic construct
YIIENGLNGYPKKPEKTLDELARDVIRGDWGNGEERYERLTEAGYDYDAVQKRVNEILYPPLKPLDEVAREVIRGDWGNGEERYRRLTEAGYDYYQVQRKVNEILYN

SEQ ID NO: 221 - protein, 202 aa, synthetic construct
SSDTAPGGGSTPSVSGTIDELARRVIAGEFGSGDTRKNALGDKYGAVQARVNEILNGTASAPAKKSVSEIAKEVLAGAWGNGDARKQKLEAAGYNYSEVQAKVNSLASGSSSSVDIDALARRVIAGEFGSGDARKKALGSNYDAVQKRVNEMLGGSSSSVNYAAIAKEVINGKWGNGAARKKKLEAAGYNYNKVQKEVNKLL

SEQ ID NO: 222 - protein, 158 aa, synthetic construct
LGTGSAASTQPNAATGSIDDLAKRTIAGEFGNGDQRRAALGANYDAVQARVNEILGGGSSSQPAVFDVDAAARDVIAGKYGNGDQRRTALGSHYDEVQARVNQMLGAAASTSVNIDAEARKVIRGDYGNGGERRNALVAKFGANVANQIQTRVNDLLR

SEQ ID NO: 223 - protein, 110 aa, synthetic construct
VYDEQGVLIYPKTNNKSIDELAREVINGLWGNGSDRKNKLISASYDYDAVQNRVNEILDGGKATPSKSIDTLAKEVIRGDWGNGADRKKRLTAAGYNYDAVQKRVNQILG

SEQ ID NO: 224 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPTPPAKPTPPAPKPSVNIDALADAVIRGEYGNGDERKRRLGSNYAAVQKRVNEKLAGRSPAKPSVNIDALADAVIRGDYGNGEERKHRLGGNYAAVQKRVNEKLGIG

SEQ ID NO: 225 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPTPPAKPTPPAPKPSANIDALADAVIRGEYGNGDERKRRLGSNYAAVQKRVNEKLAGGSPAKPSVNIDALTDAVIRGEYGNGEERKRRLGGNYAAVQKRVNEQLGIS

SEQ ID NO: 226 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPTPPAKPTPPTPKPSANIDALADAVIRGEYGNGDERKRRLGSNYAAVQKRVNEKLAGGSPAKPSVNIDALADAVIRGDYGNVEERKRRLGANYAAVQKRVNEKLGIG

SEQ ID NO: 227 - protein, 307 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSPVPKQPAKSAPTPAPSVNIDALADAVIRGEYGNGNERKRRLGANYAAVQKRVNEKLAGNTSKPSVNIDALADAVIRGEYGNGEERKRRLGANYAVVQARVNQKLGY

SEQ ID NO: 228 - protein, 310 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSQKPAEPAPAPAPAPARKDIDTVAREVIAGQWGNNPQRAEKLRAAGYDANAVQARVNQMLGAPAPKPAANIDALADAVIRGDYGNGDERRRRLGANYDAVQRRVNQKLGL

SEQ ID NO: 229 - protein, 310 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSTPAKPTPTPKPAPSVPPNIDALADAVIRGEYGNGEERKRRLGANYTAVQRRVNEKLAGKKPAAKPSGPNIDALADAVIRGEYGNGEERKRRLGNLYDQVQKRVNQKLGY

SEQ ID NO: 230 - protein, 308 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSTGTTPTPKPQPTPTPAANIDALADAVIRGDYGNGNERKRRLGANYAAVQKRVNEKLAGGSPSKPSANIDALADSVIRGDYGNGDERRRRLGENYVAVQARVNQKLGY

SEQ ID NO: 231 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPTPPAKPTPPAPKPSANIDALADAVIRGEYGNGEERKRRLGANYTAVQKRVNEKLTGGSPAKPSANIDALADAVIRGEYGNGEERKRRLGGNYAAVQKRVNEKLGIG

SEQ ID NO: 232 - protein, 307 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSTGTTPTPKPQPAPAPAPNIDALADAVIRGDYGNGNERKRHLGANYAAVQKRVNEKLAGNTSKPSVNIDALADAVIRGEYGNGEERKRRLGANYDAVQARVNQKLGY

SEQ ID NO: 233 - protein, 308 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSSGKTPAPTAKSASTPSTDIDALADAVIRGEYGNGGERKQRLGANYTAVQKRVNEKLSGAAPAKPDGPNIDALADAVIRGEYGNGDERKQRLGNLYSAVQARVNQKLG

SEQ ID NO: 234 - protein, 310 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSMTGNTPAPAPAPAPAAPNIDALADAVIRGEYGNGDERKRRLGANYAAVQQRVNEKLLGNAPATKPAGPNIDALADAVIRGEYGNGEERKRRLGNLYGAVQARVNVKLGY

SEQ ID NO: 235 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSSGTKPAPAPKPTPAPTPNIDALADAVIRGEYGNGDERRRRLGNLYDQVQRRVNEKLAGKKPAPKPAPNIDALADAVIRGEYGNGDERRRRLGSLYDQVQRRVNQKLGY

SEQ ID NO: 236 - protein, 311 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPTPPAKPTPPAPKPSVNIDALADAVIRGEYGNGEERKRKRRLGSNYAAVQKRVNEKLTGGNPNKPSVNIDALADAVIRGDYGNGEERKRRLGGNYAAVQKRVNEKLGIS

SEQ ID NO: 237 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSDQMTGTKPAPAPAAPSVNIDTFADAVIRGEYGNGDERKRRLGANYAAVQARVNEKLAGKAKPAGKSIETLAREVIRGDWGNGQERYNRLTNAGYNYQQVQNRVNQILN

SEQ ID NO: 238 - protein, 307 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSYDQISGNKPQAASASKPDIEALANAVIRGEYGNGDQRRARLGGLYDAVQRRVNEKLAAGSAPAAPNIDALADAVIRGDYGNGATRRARLGNLYNQVQARVNQKLGC

SEQ ID NO: 239 - protein, 365 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSKTAAAASVSKPAASKGPNYEALADAVIRGEYGSGEERMRRLGNAYARVQAIVNARLLGGQPTPTPLPAKPAGANIDALAKAVIRGEYGTGDARRQKLGNLYDQVQARVNQILGAGATAHRAGANIDALADAVIRGEYGNGDERRVRLGANFAAVQARVNQKLAA

SEQ ID NO: 240 - protein, 310 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSPAPAKPSPAKPAPSTPPNIDALADAVIHGDYGNGEERKRRLGSNHAAVQKRVNEKLAGKKPAVKPAGPNIDALADAVIRGGYGNGDERKRRLGGLYAQVQKRVNQKLGY

SEQ ID NO: 241 - protein, 308 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGAGGAASASPAPTVPSPDIDALAREVIAGKYGNGDDRRRALGANYGRVQARVNEILGAGARPHSQVVDVDALARAVIRGEFGNGEERKRRLGANYAAVQRRVNELLS

SEQ ID NO: 242 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGGGGNGRSASGVDSPSGDLNALADAVLRGDYGNGDERKRRLGSKYSAVQAIVNQRLGYGSTPVSSGPDLNALADAVIRGEYGNGDERRRRLGANYKAVQALVNKKLGY

SEQ ID NO: 243 - protein, 339 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSERVETGVAAENCPDGSTANLAAAVMRGEYGNGDERRKRLGSRYDEVQALINRVSSSSVDDLAKDVLNGVFGNGDTRRAVLGSRYDEVQARVNARSSSVDIDALARAVIRGEYGDGNERRTKLGANFDAVQKRVNELLK

SEQ ID NO: 244 - protein, 362 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSTGGGSSGGTTSAAPGGTVAELARRVIAGEFGNGDARRAALGSRYDEVQAEVNRILAGGSGGGAAQAPAADDVDDLARRVIAGEFGNGAARKAALGSRYAEVQARVNEMLGAGGSGGPSGGADVDALAHAVIRGDYGNGAERKRRLGSLYDAVQARVNEILS

SEQ ID NO: 245 - protein, 306 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSRVDGKPAPAIKPSSSSSNLDQLADDVLTGKYGNGDERRRRLGASYDAVQARVNQMLSVKSSAPNIDQLADDVINGKYGNGDERRRRLGASYDAVQARVNQKLGVR

SEQ ID NO: 246 - protein, 354 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGGSSSSAPSGGSAPSGSATDLAKRVIAGEFGNGDARKAALGSRYDEVQAEVNRILNGGGSSSPSVDIDQMARDVIAGKYGNGDARKAALGSNYDAVQARVNELLGAGGSATGGADIDALARAVIRGEYGNGEERKRRLGSMYEAVQARVNELL

SEQ ID NO: 247 - protein, 364 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSFGAAAGGGNGGSAPSGSVAELAQAVIRGDYGNGDARRGALGSRYDEVQAEVNRILGGGSASGGSSSGGSGADIEALAQAVIRGDYGNGDARRAALGASYDAVQARVNEILGAGGSSSGGSGGADIEALAQAVIRGEYGNGDERRHRLGSLYDAVQARVNEILL

SEQ ID NO: 248 - protein, 352 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSDVGGAPGGSGSGAPSGDVSELAERVIAGEFGNGDARRAALGSRYDEVQAEVNRILLGGGSGIDVDAMARRVIAGEFGNGDERKRRLGSNYDAVQRRVNEILLGAGSSSTSMDIDAMARAVIRGDYGNGEERRRRLGSYYSIVQSRVNEMLS

SEQ ID NO: 249 - protein, 310 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGGSGSGGSGGGPAPSGDVSELARRVINGEFGNGDVRKAALGSSYSAVQTRVNEMLGCGSSGGGSGSAGVDIDALARAVINGDYGNGEERRQRLGANYAAVQRRVNEMLS

SEQ ID NO: 250 - protein, 258 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSRVNEILGCGPSASGAASNVDALAHAVINGDYGNGEARRERLGADYEAVQRRVNELLA

SEQ ID NO: 251 - protein, 336 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSEPYISGANAVIDTIDDLSIDKLADAVISGKYGSGAERRTRLGQRYDAVQQRVNEKLAKAKLSSSAENPERKAPPKPVPAENSGKDSVVGTSPTGDLEELAAAVIQGKYGNGAERRARLGDRYQEVQNLVNRKLSS

SEQ ID NO: 252 - protein, 354 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSDVGSASTPTGSGAPSGDVSELAARVIAGDFGNGDARRAALGSRYDEVQAEVNRILSGGSSSGSYDVDALARRVIAGEFGNGDDRKRRLGDRYSTVQKRVNEILGASGASSTSMDVDAMARAVIRGDYGNGEERRRRLGSYYSIVQRRVNEMLS

SEQ ID NO: 253 - protein, 306 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPARPASQPAANSSGSSNLEALADAVIAGKYGNGEARRKALGANYAAVQAIVNRKLGAGGSTSVDLNALADAVIRGDYGNGQERKRRLGANYAAVQALVNKKLGY

SEQ ID NO: 254 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGGAVASQPAPVPSTGGVDINALADAVLRGEYGNGAERRARLGGLYDAVQAVVNQKLGATGATRGAGVDINALADGVLKGLYGNGAERRQRLGVHYDAVQAEVNRRLGY

SEQ ID NO: 255 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAGVPSAHKPPAASAPGGSVDELARAVLAGRYGNGEERKRRLGARYGEVQRRVNELIAGKAPAPSAPNLDALANAVLRGEYGNGEERRRRLGSLYQPVQDLVNRKLGIR

SEQ ID NO: 256 - protein, 308 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSYITGGGSPAAPAPSVGGDIEALAQAVICGEYGNGEDRKARLGHLYDAVQARVNAKLSGSAPAPAPGPNLDALADAVIRGDYGNGAERRNRLGHLYDAVQAIVNRKLS

SEQ ID NO: 257 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGGASAPAAKPQQSTPAVNIDDLARRAIAGEFGNGDERKAKLGGNYAAVQQRVNEMLGQGGGSSAPSVDLNALADAVIRGDYGNGEERKRRLGGNYAAVQQLVNRKLGY

SEQ ID NO: 258 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGGVPAAVKPPAPTAAGGSVDELARAVIAGKYGNGDERRRRLGNRYGEVQARVNELISGKKPAPKPANLDAIANAVLRGEYGNGDERRRRLGNLYQPVQDLVNRKLGIR

SEQ ID NO: 259 - protein, 265 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSSATKQPVDAVSSTTTATDIEEKAKSVIRGEFGNGQERKKRLGSDYSEVQKKVNEIYSKGKSKSK

SEQ ID NO: 260 - protein, 321 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSLCGKTAAPVEPEAPAKPTIDELAQEVLTGKWGNGSERKQRLEAAGHDYAAVQRRVNEILSGNAPGEPTTPPTSEELTAAEIDALARAVIRGDYGNGVTRRAKLGSKYAAVQKRVNEILRG

SEQ ID NO: 261 - protein, 402 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSATVPTPTPSTPPVAGKTVWQLADEVLAGHHGSGDDRKISLGIQYDAVQAEINRRYGVVVVAPAEKTVSQLADEVLAGAHGNGEQRRASLGNRFDEVQNEINRRLGGGGVAPQGLNIAQLADAVMRGEYGSGQDRINRLGANYDAVQQEVNRRLGGNASPVANINALADAVLRGEYGNGDERVRRLGANYAAVQAEINRRYA

SEQ ID NO: 262 - protein, 327 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSNKVSGVSTSKPSKPKSKSIDQLADEVIKGLHGSGAQRKNSLGSQYDAVQKRVNEKLLGSQPKPKPATKSIDQLVKETLAGKHGNGEARKKSLGKNYKAVQDIINGKSSAPKKTDSKPKTLKVGQKV

SEQ ID NO: 263 - protein, 407 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAVAPAATPATPPTKGKTVWQLADEVLAGHHGSGDARKASLGAQYDAVQAEVNRRLGAGTAAPKVKTISQLADEVIAGKHGTGAARQKSLGNQYTAVQNEINRRLGGGGVAPQGVNISALADRVLRGEFGSGDARVKALGKNYAAVQAEVNRRLGGGKAASAPKRVVNISALADAVIRGEYGSGEDRKRRLGANYAAVQAEVNRRYS

SEQ ID NO: 264 - protein, 358 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSPWLGSSASTPAAPPSGDLNALADAVLRGEYGNGDERKRRLGSNYAAVQAIVNQKLGAGSAPAPAPAAPAVDLNALADAVIRGEYGNGDDRRNRLGANYDAVQNLVNRKLQGAPAAGPDLNALADAVIRGEYGNGDERKRRLGANYAAVQALVNRKLR

SEQ ID NO: 265 - protein, 258 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSQTEPSPAVTPSASPSIDLEAEAAKVIRGDYGNGDERRARLGDNYRAVQNVVNRMLAQ

SEQ ID NO: 266 - protein, 360 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAPAPAPTPAPAPTPSGSIDDLAQRVINGEFGNGDARKAALGDKYDAVQARVNEMLGVGGGSHAPSPTPATDIDDLARRVINGEFGNGDARKAALGSKYDAVQARVNEMLGCGGGGGSTSVDIDTLAWKVINGDYGNGQARRDALGDLYDRVQARVNELL

SEQ ID NO: 267 - protein, 258 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSAVGNAAAAASTDVSAATIDAEARRVIHGDFGNGAQRKAALGSHYAAVQQRVNELLHV

SEQ ID NO: 268 - protein, 311 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSATVPVTPSELDATNSTSIEELAREVIRGTWGNGNERYQRLTAAGFDYDAVQARVNELVGIASKPANKNIDRLAREVIRGDWGNGQERYNRLTAAGYDYHTVQARVNQLLA

SEQ ID NO: 269 - protein, 307 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSGSTAPTAKPAPAPEKKTVETLADEVIKGLWGNGEERKRRLTASGYSYDAVQKKVNERLSVKPKKSINTLAREVIHGDWGNGNERKNRLTKAGYNYDAVQKRVNELL

SEQ ID NO: 270 - protein, 352 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSISKSTSTSDKPKTDGKSIDQLADEVIAGKHGYGDARKKALGSQYDAVQKRVNEKLGSKPKKSSKSIDTLVKETLAGKHGNGEARKKSLGSNYEAVMDVINGKASKPKKSVSQMATEVIQGKHGFGHENRRKSLGISKTEYEKVRKEVNKRL

SEQ ID NO: 271 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSTSNNSSNSKKKPSKNKSIDQLAQEVIAGKYGTGASRKKALGSQYDAVQKRVNEILLGDKPKSSGKSINQMATEVIQGKHGNGHANRRKSLGISQSEYEKVRSEVNRRL

SEQ ID NO: 272 - protein, 311 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSDANGNSVYPVESAPSKSVDTLAREVIAGNWGNGQDRVNRLTSAGYNYNSVQNRVNEILSGVSNKPSGKSIDTLAREVIRGDWGNGQDRKNRLERAGYDYDAVQKRVNELL

SEQ ID NO: 273 - protein, 312 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSDANGRSVYPVASTPSKSIDALAREVIAGNWGNGQYRVNRLRSAGYDYDAVQNRVNEILSGKSSSQSGGKSIDTLAREVIRGDWGNGQDRKNSLERAGYDYNAVQRRVNELL

SEQ ID NO: 274 - protein, 307 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSEIKNVIANVETPQITDSIEDLANEVIAGKYGNGEERKQKLGSSYDEVQRRVNEILLGKDSSTNTNEELAKEVIEGKWGNNPERKQRLLEAGYDYEAIQKIVNQRLK

SEQ ID NO: 275 - protein, 307 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSKRLGLNGFEKTDGEKADIDKIAREVIRGEWGNGEERKERLKKAGYSYEEVQNRVNELLSEDKKSIDEIANEVIRGEWGNGEERKKRLRDAGYDYDAVQKRVNEKIG

SEQ ID NO: 276 - protein, 309 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSKGNVVYPKAQPAPTKKSVDEIAREVIRGDWGNGSDRTKRLSAAGYDANAVQNRVNEILGGSSTPKKSIDEVAHEVIRGEWGNGADRKNRLIAAGYNYDAVQKRVNEIL

SEQ ID NO: 277 - protein, 313 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSVKPTPAPAPKPEPAKKSVDEIAREVIAGKWGAGEERKKLLTSAGYDYNAVQNKVNEILYDPKPQPPKKSIDQIAREVIRGDWGAGEERRKRLTAAGYDYDAVQKRVNEILYG

SEQ ID NO: 278 - protein, 308 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSYIIENGLNGYPKKPEKTLDELARDVIRGDWGNGEERYERLTEAGYDYDAVQKRVNEILYPPLKPLDEVAREVIRGDWGNGEERYRRLTEAGYDYYQVQRKVNEILYN

SEQ ID NO: 279 - protein, 403 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSSSDTAPGGGSTPSVSGTIDELARRVIAGEFGSGDTRKNALGDKYGAVQARVNEILNGTASAPAKKSVSEIAKEVLAGAWGNGDARKQKLEAAGYNYSEVQAKVNSLASGSSSSVDIDALARRVIAGEFGSGDARKKALGSNYDAVQKRVNEMLGGSSSSVNYAAIAKEVINGKWGNGAARKKKLEAAGYNYNKVQKEVNKLL

SEQ ID NO: 280 - protein, 359 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSLGTGSAASTQPNAATGSIDDLAKRTIAGEFGNGDQRRAALGANYDAVQARVNEILGGGSSSQPAVFDVDAAARDVIAGKYGNGDQRRTALGSHYDEVQARVNQMLGAAASTSVNIDAEARKVIRGDYGNGGERRNALVAKFGANVANQIQTRVNDLLR

SEQ ID NO: 281 - protein, 311 aa, synthetic construct
MTFIQAAHRGGTSNTPITRLVIHATCPDVGFPSASRAGRAVSTAEYFASTSRSASAHYVCDISTTVQCLSEATIGYHAPPNAHSIGIEICADGGSRASFEKASHAYTREQWLSPQVWPAVERAAILARDICHRHHIPIRRLSVAQVRAGERGICGHNEVSEAFHQSDHDDPGPYFPWNEFIAAVQGKTTTPEGELSMSDTSVYDEQGVLIYPKTNNKSIDELAREVINGLWGNGSDRKNKLISASYDYDAVQNRVNEILDGGKATPSKSIDTLAKEVIRGDWGNGADRKKRLTAAGYNYDAVQKRVNQILG

SEQ ID NO: 282 - protein, 182 aa, unidentified
  REGION 1..182: note = Cutibacterium acnes
MWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTSNTPAPAPAPKPAPTPKPAPNIDALADAVIRGEYGNGNERRRRLGSNYDAVQRRVNEKLRH

SEQ ID NO: 283 - protein, 197 aa, unidentified
  REGION 1..197: note = Cutibacterium acnes
MHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 284 - protein, 202 aa, unidentified
  REGION 1..202: note = Cutibacterium acnes
MDKVIIHHNAGNLTIKGCWDVWQTRPASAHYQVETSGRIGQLVWGRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 285 - protein, 24 aa, unidentified
  REGION 1..24: note = Cutibacterium acnes
NERRRRLGSNYDAVQRRVNEKLRH

SEQ ID NO: 286 - protein, 202 aa, unidentified
  REGION 1..202: note = Cutibacterium acnes
MDKVIIHHNVGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 287 - protein, 202 aa, unidentified
  REGION 1..202: note = Cutibacterium acnes
MDKVIIHHNAGNLIIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 288 - protein, 202 aa, unidentified
  REGION 1..202: note = Cutibacterium acnes
MDKVIIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARTQYWYDHMTGNTPAPAPAPKPAPTPKPAPNIDALADAVIRGEYGNGNERRRRLGSNYDAVQRRVNEKLRH

SEQ ID NO: 289 - protein, 198 aa, unidentified
  REGION 1..198: note = Cutibacterium acnes
MIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 290 - protein, 182 aa, unidentified
  REGION 1..182: note = Cutibacterium acnes
MWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 291 - protein, 199 aa, unidentified; identical to SEQ ID NO: 38
  REGION 1..199: note = Cutibacterium acnes

SEQ ID NO: 292 - protein, 199 aa, unidentified
  REGION 1..199: note = Cutibacterium acnes
MIIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTSNTPAPAPAPKPAPTPKPAPNIDALADAVIRGEYGNGNERRRRLGSNYDAVQRRVNEKLRH

SEQ ID NO: 293 - protein, 63 aa, unidentified
  REGION 1..63: note = Cutibacterium acnes
MTGNTPAPAPAPKPAPTPKPAPNIDALADAVIRGEYGNGNERRRRLGSNYDAVQRRVNEKLRH

SEQ ID NO: 294 - protein, 63 aa, unidentified
  REGION 1..63: note = Cutibacterium acnes
MTSNTPAPAPAPKPAPTPKPAPNIDALADAVIRGEYGNGNERRRRLGSNYDAVQRRVNEKLRH

SEQ ID NO: 295 - protein, 202 aa, unidentified
  REGION 1..202: note = Cutibacterium
MDKVIIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 296 - protein, 202 aa, unidentified
  REGION 1..202: note = Actinomycetes
MDKVIIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTSNTPAPAPAPKPAPTPKPAPNIDALADAVIRGEYGNGNERRRRLGSNYDAVQRRVNEKLRH

SEQ ID NO: 297 - protein, 227 aa, unidentified
  REGION 1..227: note = Lawsonella clevelandensis
RGCFASSRSGVRVPYAPPKDAPATESTRSIIHHNAGNLTIKGCWDVWQTRPASAHYQVETSGRIGQLVWDRDTAWHAGNWAANTTSIGIEHADASSNPWKISDACLDNGAHLVAAICRYYKLGRPTWGKNVFGHKNFSATECPASLAGTQHAAYMARAQYWYDHMTGNTPAPAPAPKPAPTPKPAPNIDALADAVIRGEYGNGNERRRRLGSNYDAVQRRVNEKLRH

SEQ ID NO: 298 - protein, 280 aa, Corynebacterium striatum
MKNWATLEADENRLMNKHYTKGRNGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSVNIDALADAVIRGEYGNGDERKRRLGSNYAAVQKRVNEKLTGGNPNKPSVNIDALADAVIRGDYGNGEERKRRLGGNYAAVQKRVNEKLGIS

SEQ ID NO: 299 - protein, 467 aa, Corynebacterium aurimucosum
MPLEISTLPISAILPADYNPRKDLQPGDAEYEKLKASIEKFGYVELVVVIKRNDYTAISGHQRLKVLADLGIQEIECVVVDLDENQEKALNIAMNKISGEWDEPKLALLIADLQTADFDVNLTGFDTDEIEALLSLGAEREVTDDGFDLNAALEEAAFVQEGDLWTLGEHKLLCGDATKAEDVERLMGGKQATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNCAHLVAAICHYYKLGRPVWGKNVFGHKHFSATECPASLAGSQHAAYMARAQYWYDRMSGTKPAPTPPAKPTPPAPKPSVNIDALADAVIRGEYGNGEERKRRLGSNYAAVQKRVNEKLTGGNPNKPSVNIDALADAVIRGDYGNGEERKRRLGGNYAAVQKRVNEKLGIS

SEQ ID NO: 300 - protein, 124 aa, Corynebacterium striatum
MARAQYWYDRMSGTKPAPTAPAKPTPPAPKPSVNIDALADAVIRGEYGNGDERKRRLGSNYAAVQKRVNEKLAGRSPAKPSVNIDALADAVIRGDYGNGEERKRRLGGNYAAVQKRVNEKLGIG

SEQ ID NO: 301 - protein, 280 aa, Corynebacterium diphtheriae
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSANIDALADAVIRGEYGNGDERKRRLGSNYAAVQKRVNEKLTGGNPNKPSVNIDALADAVIRGDYGNGEERKRRLGGNYAAVQKRVNEKLGIS

SEQ ID NO: 302 - protein, 280 aa, Corynebacterium striatum; identical to SEQ ID NO: 108

SEQ ID NO: 303 - protein, 140 aa, Corynebacterium striatum
STECPASLAGSQHAAYMARAQYWYDRMSGTKPAPTAPAKPTPPAPKPSVNIDALADAVIRGEYGNGDERKRRLGSNYAAVQKRVNEKLAGRSPAKPSVNIDALADAVIRGDYGNGEERKHRLGGNYAAVQKRVNEKLGIG

SEQ ID NO: 304 - protein, 280 aa, Corynebacterium striatum
MKNWATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSFNIDALADAVIRGEYGNGDERKRRLGSNYAAVQKRVNEKLAGGSPAKPSVNIEALADAVIRGDYGNGEERKRRLGGNYAAVQKRVNEKLGIG

SEQ ID NO: 305 - protein, 124 aa, unidentified; identical to SEQ ID NO: 109
  REGION 1..124: note = Dermabacter hominis 1368

SEQ ID NO: 306 - protein, 262 aa, Bifidobacterium animalis; identical to SEQ ID NO: 112

SEQ ID NO: 307 - protein, 155 aa, Corynebacterium riegelii
MGNVRRRHGSNHCIASTECPASLAGSQHAAYMARAQYWYDRMSGTKPAPTPPAKPTPPAPKPSANIDALADAVIRGEYGNGDERKRRLGSNYAAVQKRVNEKLAGGSPNKPSVNIDALADAVIRGEYGNGEERKRRLGANYAAVQKRVNEKLGIS

SEQ ID NO: 308 - protein, 275 aa, unidentified; identical to SEQ ID NO: 119
  REGION 1..275: note = Actinomycetaceae bacterium

SEQ ID NO: 309 - protein, 280 aa, Corynebacterium diphtheriae
MKNWATLEADENRLMNKHYSAGRSGRKINKVIIHHNAGNLTIKSIWDVWQTRQASAHYQVDSNGRIGQLVWDRNTAWHAGNWEANTTSIGIEHADISSKPWRISEACLDNGAHLVAAICHYYKLGRPVWGKNVFGHKHFSSTECPASLAGSQHAAYMAHAQYWYDRMSGTKPAPTAPAKPTPPTPKPSANIDALADAVIRGEYGNGDERKRRLGSNYAAVQKRVNEKLAGGSPAKPSVNIDALADAVIRGEYGNGEERKRRLGGNYAAVQKRVNEKLGIG

SEQ ID NO: 310 - protein, 280 aa, Corynebacterium resistens
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTAPAKPTPPAPKPSVNIDALADAVIRGEYGNGDERKRRLGSNYAAVQKRVNEKLAGRSPAKPSVNIDALADAVIRGDYGNGEERKHRLGGNYAAVQKRVNEKLGIG

SEQ ID NO: 311 - protein, 273 aa, unidentified; identical to SEQ ID NO: 37
  REGION 1..273: note = Cutibacterium avidum

SEQ ID NO: 312 - protein, 270 aa, unidentified
  REGION 1..270: note = Actinomycetes
MKNWNTLDADINLLLDKHYSKGRQGRQIDKIILHHNAGNLSVRGCFDTWQTRQASAHYQVESTGIIGQLVWDGDTAWHAGNWDANLTSIGIEHADASNSPWRISDVCLENGAHLVAALCVYYKLGRPEWGKNIFGHSHFSPTECPASIAGSQRTAYMARAGYWYDQMTGNKPVAIPTPAATAQNIDALADAVIRGEYGNGDTRRARLGGLYDAVQRRVNEKLGAGSSFGLNIDALADAVIRGEYGNGDERRRRLGSLYDAVQARVNQKLS

SEQ ID NO: 313 - protein, 279 aa, Trueperella pyogenes
MKNWNTLEADENRILAKHYTAGRGGRSINKVIIHHNAGNLTIPGIYEVWQTRRASAHYQVDSQGRIGQLVWDSDTAWHAGNWDANTTSIGIEHADISSNPWRISDACLEEGAHLTAAVCKYYGLGRPQWGKNVFGHKHFSPTECPASLAGTQHAAYMARAQYWYDQMTGKVPAPKPKVPTAPAPKPAPSVSIDALADAVIRGEYGNGNERKRRLGANYAAVQKRVNEKLAGNTSKPSANIDALADAVIRGEYGNGEERKRRLGANYAAVQKRVNQKLGY

SEQ ID NO: 314 - protein, 270 aa, unidentified
  REGION 1..270: note = Propionimicrobium lymphophilum
MKNWNTLDADINLLLDKHYSKGRQGRQIDKIILHHNAGNLSVRGCFDTWQTRQASAHYQVESTGIIGQLVWDGDTAWHAGNWDANLTSIGIEHADASNSPWRISDVCLENGAHLVAALCVYYKLGRPEWGRNVYGHNHFSPTECPASIAGNQRAEYMARAGYWYDQMTGNKPVATPTPATTAPNLDALADAVIRGEYGNGDTRRARLGGLYDAVQRRVNEKLGAGSSFGPNIDALADAVIRGEYGNGDERRRRLGNLYDAVQRRVNQKLS

SEQ ID NO: 315 - protein, 281 aa, Corynebacterium aurimucosum
MGGKQATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNCAHLVAAICHYYKLGRPVWGKNVFGHKHFSATECPASLAGSQHAAYMARAQYWYDRMSGTKPAPTPPAKPTPPAPKPSVNIDALADAVIRGEYGNGEERKRRLGSNYAAVQKRVNEKLTGGNPNKPSVNIDALADAVIRGDYGNGEERKRRLGGNYAAVQKRVNEKLGIS

SEQ ID NO: 316 - protein, 280 aa, unidentified
  REGION 1..280: note = Winkia neuii
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSVNIDALADAVIRGEYGNGDERKRRLGSNYAAVQKRVNEKLTGGNPNKPSVNIDALADAVIRGDYGNGEERKRRLGGNYAAVQKRVNEKLGIS

SEQ ID NO: 317 - protein, 280 aa, Actinobaculum suis
MKNWATLEADENRLMNKHYSAGRSGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTAPAKPTPPAPKPSVNIDALADAVIRGEYGNGDERKRRLGSNYAAVQKRVNEKLAGRSPAKPSVNIDALADAVIRGDYGNGEERKRRLGGNYAAVQKRVNEKLGIG

SEQ ID NO: 318 - protein, 280 aa, unidentified
  REGION 1..280: note = Arthrobacter sp. HMSC08H08
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSANIDALADAVIRGEYGNGEERKRRLGSNYAAVQKRVNEKLTGGNPTKPSVNIDALADAVIRGDYGNGEERKRRLGANYAAVQKRVNEKLGIS

SEQ ID NO: 319 - protein, 280 aa, unidentified
  REGION 1..280: note = Cutibacterium avidum
MKNWATLEADENRLMNKHYTKGRNGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRLSGTKPAPTAPAKPTPPAPKPSVNIDALADAVIRGEYGNGDERKRRLGSNYAAVQKRVNEKLTGGNPNKPSVNIDALADAVIRGDYGNGEERKRRLGGNYAAVQKRVNEKLGIS

SEQ ID NO: 320 - protein, 268 aa, Corynebacterium coyleae
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSNPWQISAKCLEEGAHLTAAVCKYYGLGRPQWGKNVFGHKHFSPTECPASLAGTQHAAYMARAQYWYDQMTGKALAPKPSANIDALADAVIRGEYGNGNERKRRLGANYAAVQKRVNEKLAGKTPAKPSVNIDALADAVIRGEYGNGDERKRRLGANYAAVQARVNQKLGY

SEQ ID NO: 321 - protein, 280 aa, unidentified
  REGION 1..280: note = Pseudoglutamicibacter albus
MIPRATLEADENRLMNKHYTKGRNGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSVNIDALADAVIRGEYGNGDERKRRLGSNYAAVQKRVNEKLAGGNPTKPSVNIDALADAVIRGDYGNGEERKRRLGGNYAAVQKRVNEKLGIS

SEQ ID NO: 322 - protein, 280 aa, Corynebacterium aurimucosum
MKNWATLEADENRLMNKHYTKGRNGRKINKVIIHHNAGNLTIKSIWDVWQTRQASAHYQVDSSGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSVNIDALADAVIRGEYGNGDERKRRLGSNYAAVQKRVNEKLTGGNPNKPSVNIDALADAVIRGEYGNGDERKRRLGANYAAVQKRVNEKLGIS

SEQ ID NO: 323 - protein, 270 aa, Mobiluncus mulieris
MKNWNSLDADINLLLDKHYSKGRQGRQIDKIILHHNAGNLSVRGCFDTWQTRQASAHYQVESTGIIGQLVWDGDTAWHAGNWDANLTSIGIEHADCSSNPWRISDVCLENGAHLVAALCVYYKLGRPEWGKNIFGHSHFSPTECPASIAGNQRAEYMARAGYWYDQMTGNKPVATPTPAATAQNIDALADAVIRGEYGNGDTRRARLGGLYDAVQRRVNEKLGAGSSFGPNIDALADAVIRGEYGNGDERRRRLGSLYDAVQARVNQKLS

SEQ ID NO: 324 - protein, 277 aa, unidentified; identical to SEQ ID NO: 111
  REGION 1..277: note = Trueperella pecoris

SEQ ID NO: 325 - protein, 124 aa, Dermabacter hominis; identical to SEQ ID NO: 109

SEQ ID NO: 326 - protein, 277 aa, Arcanobacterium pluranimalium
MKNWDTLDADENQILATHFTPGRSGRRIDKIIIHHNAGNLTIAGCYQVWQTRPASAHYQVDSNGRIGQLVWDRNTAWHAGNWEANTTSIGIEHADISSNPWRISDACLDNGAHLVAALCKFYQLGRPTWGKNVFGHKNFSATQCPASLAGTQHAAYMARAQYWYDQMTGKDPVPKQPAKPAPTPAPSVNIDALADAVIRGEYGNGNERKRRLGANYAAVQKRVNEKLAGNTSKPSVNIDALADAVIRGEYGNGEERKRRLGANYAVVQARVNQKLGY

SEQ ID NO: 327 - protein, 74 aa, Trueperella pyogenes
MARAQYWYDRMSGTKPPHSTGKAHTARTQASVNIDALADAVIRGEYGNGDERKRRLGSNYAAVQKRVNEKLGIS

SEQ ID NO: 328 - protein, 124 aa, Corynebacterium striatum; identical to SEQ ID NO: 110

SEQ ID NO: 329 - protein, 280 aa, Corynebacterium amycolatum
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGEYGNGDERKRRLGSNYAAVQKRVNEKLAGGSPAKPSVNIDALTDAVIRGEYGNGEERKRRLGGNYAAVQKRVNEQLGIS

SEQ ID NO: 330 - protein, 270 aa, Mobiluncus mulieris
MKNWNTLDADINLLLDKHYSKGRQGRQIDKIILHHNAGNLSVRGCFDTWQTRQASAHYQVESTGIIGQLVWDGDTAWHAGNWDANLTSIGIEHADASNSPWRISDVCLENGAHLVAALCVYYKLGRPEWGKNIFGHSHFSPTECPASIAGNQRAEYMARAGYWYDQMTGNKPVATPTPAATAQNIDALADAVIRGEYDNGDTRRARLGGLYDAVQRRVNEKLGAGSSFGPNIDALADAVIRGEYGNGDERRRRLGSLYDAVQARVNQKLS

SEQ ID NO: 331 - protein, 279 aa, Actinomyces sp.; identical to SEQ ID NO: 113

SEQ ID NO: 332 - protein, 280 aa, Corynebacterium striatum
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSSTECPASLAGSQHAAYMAHAQYWYDRMSGTKPAPTAPAKPTPPTPKPSANIDALADAVIRGEYGNGDERKRRLGSNYAAVQKRVNEKLAGGSPAKPSVNIDALADAVIRGEYGNGEERKRRLGGNYAAVQKRVNEKLGIG

SEQ ID NO: 333 - protein, 280 aa, unidentified
  REGION 1..280: note = Arcanobacterium wilhelmae
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPTWGKNVFGHTHFSSTECPASLAGSQHAAYMARAQYWYDRMSGSKPAPTPPAKPTPPTPKPSANIDALADAVIRGEYGNGDERKRRLGSNYAAVQKRVNEKLAGGSPAKPSVNIDALADAVIRGDYGNGEERKRRLGANYAAVQKRVNEKLGIS

SEQ ID NO: 334 - protein, 270 aa, unidentified
  REGION 1..270: note = uncultured Actinomyces sp.
MKNWNTLDADINLLLDKHYSKGRQGRQIDKIILHHNAGNLSVRGCFDTWQTRQASAHYQVESTGIIGQLVWDGDTAWHAGNWDANLTSIGIEHADASNSPWRISDVCLENGAHLVAALCVYYKLGRPEWGKNIFGHSHFSPTECPASIAGNQRAEYMARAGYWYDQMTGNKPVATPTPAATAQNIDALADAVIRGEYGNGDTRRARLGGLYDAVQRRVNEKLGAGSSFGPNIDALADAVIRGEYGNGDERRRRLGSLYDAVQARVNQKLS

SEQ ID NO: 335 - protein, 280 aa, Trueperella bernardiae
MKNWATLEADENRLMNKHYTKGRNGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTAPAKPTPPAPKPSANIDALADAVIRGEYGNGDERKRRLGSNYAAVQKRVNEKLTGGSPAKPSVNIDALADAVIRGEYGNGEERKRRLGGNYAAVQKRVNEKLGIG

SEQ ID NO: 336 - protein, 280 aa, unidentified
  REGION 1..280: note = Gulosibacter sp. GYB002
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWAKNVFGHKHFSATECPASLAGSQHAAYMARAQYWYDRMSGTKPAPTAPAKPTPPAPKPSANIDALADAVIRGEYGNGDERKRRLGSNYAAVQKRVNEKLTGGSPAKPSVNIDALADAVIRGDYGNGEERKRRLGGNYAAVQKRVNEKLGIS

SEQ ID NO: 337 - protein, 280 aa, unidentified; identical to SEQ ID NO: 298
  REGION 1..280: note = Cutibacterium avidum

SEQ ID NO: 338 - protein, 318 aa, Trueperella pyogenes
MTFSPLCARSVPTKNYSSRQGNKVRRLIIHYTAGGTDESNVRLLSRSQDYGRQASCTYVLQRNGALVGIVPEEYRPWTSGSFSADATAVTVETVIAPKGQATAAQMETLAKLAADLSNRYGWGPLNRTNVRGHREFAATDCPGPYLWPRMNQIVERANQIRGGATPKPQPTPAPSGDIDALADAVIRGEYGNGDERRRRLGNKYEAVQRRVNDKLTGKQPAKPTPKPATNIDALADAVIRGEYGNGEERKRRLGSNYAAVQARVNEKLAGKSPKPSVDIDALADAVIRGEYGNGDERKRRLGSNYAAVQARVNQKLGY

SEQ ID NO: 339 - protein, 65 aa, Corynebacterium macginleyi
MSGTKPAPTAPAKPTPPAPKPSVNIDALADAVIRGEYGNGDERKRRLGSNYAAVQERVNEKPGIG

SEQ ID NO: 340 - protein, 75 aa, Corynebacterium macginleyi
MARAQYWYDRMSGTKPAPTAPAKPTPPAPKPSVNIDALADAVIRGEYGNGDERKRRLGSNYAAVQERVNEKPGIG

SEQ ID NO: 341 - protein, 121 aa, Corynebacterium macginleyi
MPTSSLPSATTTGSDTPCGGKNVFGHKHFSATECPASLAGSQHAAYMARAQYWYDRMSGTKPAPTAPAKPTPPAPKPSVNIDALADAVIRGEYGNGDERKRRLGSNYAAVQERVNEKPGIG

SEQ ID NO: 342 - protein, 280 aa, Dermabacter hominis
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSANIDALADAVIRGEYGNGEERKRRLGANYAAVQKRVNEKLTGRSPAKPSANIDALANAVIRGEYGNGEERKRRLGGNYAAVQKRVNEKLGIS

SEQ ID NO: 343 - protein, 315 aa, unidentified
  REGION 1..315: note = Gleimia europaea
MNKHYSAGRSGRKINKVIIHHNAGNLTIKSIWDVWQTRQASAHYQVDSGGWIGQLVWDRDTAWHAGNWDTNTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSVNIDALADAVIRGEYGNGEERKRRLGANYAAVQKRVNEKLTGGNPTKPSVNIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 344 - protein, 124 aa, Corynebacterium coyleae
MARAQYWYDRMSGTKPAPTPPAKPTPPAPKPSVNIDALADAVIRGEYGNGDERKRRLGANYTAVQKRVNEKLTGGSPAKPSVNIDALADAVIRGDYGNGEERKRRLGANYAAVQKRVNDKLGIS

SEQ ID NO: 345 - protein, 231 aa, Corynebacterium diphtheriae
MKNWATLEADENRLMNKHYSAGRSGRKINKVIIHHNAGNLTIKSIWDVWQTRQASAHYQVDSGGRIGQLVWDRDTAWHAGNWEANTTSIGIEHADIFSKPWRISEACLDNGAHLVAAICHYYKLGRPVWGKNVFGHKHFSSTECPASLAGSQHAAYMARAQYWYDRMSGTKPAPTPPAKPTPPAPKPSVNIDALADAVIRGEYGNGEERKRRLGGNYAAVQKRVNEKLGIG

SEQ ID NO: 346 - protein, 231 aa, Corynebacterium diphtheriae
MKNWATLEADENRLMNKHYSAGRSGRKINKVIIHHNAGNLTIKSIWDVWQTRQASAHYQVDSGGRIGQLVWDRDTAWHAGNWEANTTSIGIEHADIFSKPWRISEACLDNGAHLVAAICHYYKLGRPVWGKNVFGHKHFSSTECSASLAGSQHAAYMARAQYWYDRMSGTKPAPTPPAKPTPPAPKPSVNIDALADAVIRGEYGNGEERKRRLGGNYAAVQKRVNEKLGIG

SEQ ID NO: 347 - protein, 280 aa, Corynebacterium diphtheriae
MKNWATLEADENRLMNKHYSAGRSGRKINKVIIHNNAGNLTIKSIWDVWQTRQASAHYQVDSNGRIGQLVWDRDTAWHAGNWEANTTSIGIEHADISSKPWHISDKCLEEGAHLVAAICHYYKLGRPTWGKNVFGHKHFSSTECPASLAGSQHAAYMARAQYWYDRMSGTKPAPTPPAKPIPPAPKSSANIDTLADAVIRGEYGNGDERKRRLGSKYAAVQKRVNEKLAGTKPSTPAVNIDALADAVIRGEYGNGEERKRRLGANYAAVQKRVNEKLGIG

SEQ ID NO: 348 - protein, 278 aa, Corynebacterium diphtheriae
MKNWATLEADENRLMNKHYSTGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPTWGKNVFGHKHFSSTECPASLAGSQHAAYMARAQYWYDRMSGTKPAPTPPAKPTPPKPSANIDALADAVIRGEYGNGEERKRRLGGNYAAVQKRVNEKLAGGSPTRPSVNIDALADAVIRGEYGNGEERKRRLGGNYAAVQKRVNEKLGIG

SEQ ID NO: 349 - protein, 275 aa, Chlamydia trachomatis; identical to SEQ ID NO: 118

SEQ ID NO: 350 - protein, 335 aa, unidentified
  REGION 1..335: note = Mobiluncus holmesii ATCC 35242
MKNWLALEADIDLIMNTHYTPGRNGRRIDKVIIHHNAGNLTIRGCYDVWQTRPASAHYQVETSGRIGQLVWDRDTAWHAGNWVANTTSIGIEHADASIRPYRISDACLENGAHLVAALCHYYELGRPTWGKNVFGHCDFSATECPASIAGSQHATYMARAIYWYDQMTSSKVSATPAPASKPAPSTPPNIDALADAVIRGDYGNGAERKRRLGSNYAAVQKRVNEKLAGSAPKPSAPTPAPSVNIDALADAVIRGDYGNGDERKRRLGTNYAAVQQRVNEKLSGNASAPKPAGPNIDALADAVIRGEYGNGEERKRRLGNLYSAVQARVNAKLGY

SEQ ID NO: 351 - protein, 273 aa, Corynebacterium striatum
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTPPAKPTPPAPKPSVNIDALADAVIRGAYGNGDERKRRLGSNYAAVQKRVNEKLTGGNIDALADAVIRGDYGNGEERKRRLGGNYAAVQKRVNEKLGIS

SEQ ID NO: 352 - protein, 279 aa, Corynebacterium striatum
MKNWATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISDACLEEGAHLTAAVCKYYGLGRPQWGKNVFGHKHFSATECPASLAGTQHAAYMARAQYWYDQMTGKAPAPKPKAPTAPAPKPAPSVSIDALADAVIRGEYGNGNERKRRLGNKYAAVQKRVNEKLAGNTSKPSVNIDALADAVIRGEYGNGKERKRRLGANYAAVQKRVNQKLGY

SEQ ID NO: 353 - protein, 190 aa, Corynebacterium striatum
IEHADISSKPWRISEACLDNGAHLVAAICHYYKLGRPVWGKNVFGHKHFSATECPASLAGSQHAAYMARAQYWYDRMSGTKPAPTPPAKPTPPAPKPSANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 354 - protein, 280 aa, Corynebacterium striatum
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSANIDALADAVIRGEYGNGEERKRRLGANYAAVQKRVNEKLTGGNPTKPSVNIDALADAVIRGDYGNGEERKRRLGGNYAAVQKRVNEKLGIS

SEQ ID NO: 355 - protein, 106 aa, Corynebacterium striatum
TPPAKPTPPAPKPSANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 356 - protein, 281 aa, Arcanobacterium sp.
MKDWNNLTADQNLLMNKHYTPGRAGHSINTIVLHHNAGRLSIQECWNVWQTRQASAHYQVDVNGRIGQLVWDRDTAWHAGNWEANCTSIGIEHANNQVGNPWTISDATLENGAHLVAALCRYYKLGRPQWGKNVFGHKNFAATGCPGEIAGTQNTRYMARAQYWYDEMTGKVPAPKPKAPTAPAPKPAPSVNIDALADAVIRGEYGNGEERKRRLGANYAAVQARVNEKLAGKTTAKPSVNIDALADAVIRGEYGNGDERRRRLGANYAAVQKRVNQKLGY

SEQ ID NO: 357 - protein, 227 aa, unidentified
  REGION 1..227: note = Corynebacterium sp. 35RC1
MKNWATLEADENRLLNKHYSAGRSGRKINKVIIHHNAGNLSIKSIWDVWQTRQASAHYQVDSNGRIGQLVWDRDTAWHAGNWDANTTSIGIEHADISSKPWRISEACLDNGAHLVAAICHYYKLGRPVWGKNVFGHKHFSSTECPASLAGSQHEAYMARAQYWYDQMTGKPPAPKPKAPAPKPSANIDALADAVIRGEYGNGDERKRRLGGNYAAVQKRVNEKLGIR

SEQ ID NO: 358 - protein, 274 aa, unidentified
  REGION 1..274: note = Actinomycetaceae bacterium
MKNWNTLEADIDLIMNKHYTPGRNGRKIDKVIIHHNAGNLTTKGCWDVWQTRQASAHYQVQSDGTIGQLVWDSDTAWHAGNWDANTTSIGIEHADATTTPWSVSQACLDNGAHLVAAICKYYKLGRPAWGKNVLGHSHFSATACPASLAGSQHQAYMARAGYWYDQMSGTTPTPKPQPAPAPAVNIDALADAVIRGDYGNGEERKRRLGANYAAVQKRVNEKLAGKTTTKPSVNIDALADAVIRGEYGNGDERRRRLGANYAAVQKRVNQKLGY

SEQ ID NO: 359 - protein, 124 aa, Corynebacterium coyleae; identical to SEQ ID NO: 344

SEQ ID NO: 360 - protein, 325 aa, Arcanobacterium hippocoleae
MKNWLALEADIDLIMNKHYTPGRNGRRIDKVIIHHNAGNLTIRGCYDVWQSRPASAHYQVQSDGRIGQLVWDRDTAWHAGNWVANTTSIGIEHADMTSDSWAVSEACLDNGAHLVAAICKFYGLGRPAWGKNVFGHKDFSATACPASLAGSQHAAYMARAQSWYDQMTGSAPAPAPAAPNIDALADAVIRGEYGNGDERKRRLGANYAAVQARVNEKLSGNAPTPTPAPAPATPNIDALADAVIRGEYGNGDERKRRLGANYAAVQQRVNEKLSGRTPAKPAAPNIDALADAVIRGDYGNGEERKRRLGNLYGAVQARVNAKLGY

SEQ ID NO: 361 - protein, 280 aa, Actinomyces sp.
MKNWNTLEADIDLIMNTHYTPGRNGRRIDKVVIHHNAGNLTIKGCYDVWQTRPASAHYQVQTDGRIGQLVWDRDTAWHAGNFAANTTSIGIEHADMTSDPWTVSEACLDNGAHLVAAICKFYKLGRPTWGKNVFGHKNFSATECPASLAGSQHKAYMARAQYWYDHMTGSAPAQSKPSPAKPKPAPKPSNIDAMADAVIRGNYGNGEERKRRLGSNYAAVQKRVNEKLAGKKPSPKPAVNIDALADAVIRGDYGNGEERKRRLGSDYAAVQRRVNEKLRY

SEQ ID NO: 362 - protein, 121 aa, Actinomyces sp.
AQYWYDHMTGSAPAQSKPSPAKPKPAPKPSNIDAMADAVIRGNYGNGEERKRRLGSNYAAVQKRVNEKLAGKKPSPKPAVNIDALADAVIRGDYGNGEERKRRLGSDYAAVQRRVNEKLRY

SEQ ID NO: 363 - protein, 280 aa, unidentified; identical to SEQ ID NO: 115
  REGION 1..280: note = Cutibacterium avidum

SEQ ID NO: 364 - protein, 281 aa, Arcanobacterium sp.
MKDWNNLQADQNLLMNKHYTPGRAGHSINTIVLHHNAGRLSIQECWNVWQTRQASAHYQVDVNGRIGQLVWDRDTAWHAGNWEANCTSIGIEHANNQVGNPWTISDATLENGAHLVAALCRYYKLGRPQWGKNVFGHKNFAATGCPGEIAGTQNTRYMARAQYWYDEMTGKVPAPKPKAPTAPAPKPAPSVNIDALADAVIRGEYGNGEERKRRLGANYAAVQARVNEKLAGKTTAKPSVNIDALADAVIRGEYGNGDERRRRLGANYAAVQKRVNQKLGY

SEQ ID NO: 365 - protein, 230 aa, Actinomyces bovis
MKNWATFEADENRLMNKHYTKGRNGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPAWGKNVFGHKHFSATECPASLAGSQHAAYMARAQYWYDRMSGTKPAPTPPAKPTPPAPKPSVNIDALADAVIRGEYGNGEERRRRLGANYAAVQKRVNQKLGY

SEQ ID NO: 366 - protein, 277 aa, Mobiluncus curtisii
MKNWNTLEADIDLIMNTHYTPGRNGRRIDKVIIHHNAGNLTIRGCYDVWQSRPASAHYQVQTDGTIGQLVWDRDTAWHAGNFAANTTSIGIEHADMASDPWTVSEACLDNGAHLVAAVCKFYGLGRPAWGKNVFGHKDFSATACPASLAGSQHAAYMARAQSWYDQMTGTATTPVPAPAPAPAAPNIDALADAVIRGEYGNGDERKRRLGTNYAAVQARVNEKLLGNAPAPKPAGPNIDALADAVIRGDYGNGEERKRRLGNLYSAVQARVNAKLGY

SEQ ID NO: 367 - protein, 280 aa, unidentified
  REGION 1..280: note = Actinomycetaceae
MKNWATLEADENRLMNKHYSAGRSGRKMNKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRLSGTKPAPTPPAKPTPPAPKPSANIDALADAVIRGEYGNGDERKRRLGSKYAAVQKRVNEKLAGGSPAKPSVNIDALADAVIRGEYGNGEERKRRLGGNYAAVQKRVNEKLGIG

SEQ ID NO: 368 - protein, 278 aa, Corynebacterium resistens
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPTWGKNVFGHKHFSSTECPASLAGSQHAAYMARAQYWYDRMSGTKPAPTPPAKPTPPKPSANIDALADAVIRGEYGNGEERKRRLGGNYAAVQKRVNEKLAGGSPTRPSVNIDALADAVIRGEYGNGEERKRRLGGNYAAVQKRVNEKLGIG

SEQ ID NO: 369 - protein, 279 aa, unidentified
  REGION 1..279: note = Winkia neuii
MKNWLALEADIDLIMNKHYTPGRNGRKIDKVIIHHNAGNLTIRGCYDVWQTRPASAHYQVQSDGRIGQLVWDRDTAWHAGNFAANTTSIGIEHADVSSNPWAVSEACLDNGAHLVAAICKFYGLGRPAWGKNVFGHKDFSATACPASLAGSQHAAYMAKAQSWYDQMTGSAPAPAPAAPNIDALADAVIRGEYGNGDERKRRLGANYAAVQARVNEKLSGNAPTPTPAPAPAPAPATPNIDALADAVIRGEYGNGEERKRRLGNLYSAVQARVNAKLGY

SEQ ID NO: 370 - protein, 274 aa, unidentified
  REGION 1..274: note = Propionimicrobium lymphophilum
MKNWNSLDADINLLLECHYTKGRQGRTIDKIVLHHNAGNLSVRGCFETWQTRQASAHYQVQSDGIIGQLVWDGDTAWHAGNWEANLTSIGIEHADASSNPWRISQACLENGAHLVAALCVYYRLGRPEWGRNVYGHNHFSPTECPASIAGSQRAAYMARAQYWYDHMTGSAPAPASAKPAPSTPNIDALADAVIRGDYGNGEERKRRLGSNYAAVQKRVNEKLAGRAPAKLGPNIDTLADAVIRGEYGNGEERKRRLGNLYSAVQARVNAKLGY

SEQ ID NO: 371 - protein, 216 aa, Corynebacterium vitaeruminis
RIGQLVWDRDTAWHAGNWEANTTSIGIEHADISSKPWRISEACLDNGAHLVAAICYYYKLGRPVWGKNVFGHKHFSSTECPASLAGSQHAAYMARAQYWYDRMSGTKPAPTPPAKPTPPTPKPSANIDALADAVIRGDYGNGEERKRRLGSNYAAVQKRVNEKLAGASPAKPSVNIDALADAVIRGDYGNGEERKRRLGANYAAVQKRVNEKLGIG

SEQ ID NO: 372 - protein, 280 aa, Corynebacterium atypicum
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSVNIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 373 - protein, 273 aa, Actinobaculum suis; identical to SEQ ID NO: 116

SEQ ID NO: 374 - protein, 273 aa, unidentified
  REGION 1..273: note = Actinomycetaceae
MKNWLALEADIDLIMNTHYTPGRNGRRIDKVIIHHNAGNLTIRGCYDVWQTRPASAHYQVETSGRIGQLVWDRDTAWHAGNWVANTTSIGIEHADVSSSPWAVSEACLDNGAHLVAAVCKFYGLGRPQWGKNVFGHKDFSATACPASLAGSQHAAYMARAQSWYDQMTGNTPAPAPAPATPDIDALADAVIRGEYGNGDERKRRLGANYAAVQARVNEKLSGNASAPKPAGPNIDALADAVIRGEYGNGEERKRRLGNLYGAVQARVNAKLGY

SEQ ID NO: 375 - protein, 280 aa, unidentified
  REGION 1..280: note = Actinomycetes
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 376 - protein, 280 aa, unidentified
  REGION 1..280: note = Corynebacterium sp. HMSC034B08
MKNWATLEADENRLMNKHYSAGRSGRKMNKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSVNIDALADAVIRGEYGNGDERKRRLGSKYAAVQKRVNEKLAGGSPAKPSVNIDALADAVIRGDYGNGEERKRRLGGNYAAVQKRVNEKLGIG

SEQ ID NO: 377 - protein, 271 aa, unidentified
  REGION 1..271: note = Varibaculum massiliense
MKNWNSLDADINLLLDKHYSKGRQGRAIDKIILHHNAGNLSVRGCFDTWQTRQASAHYQVESTGIIGQLVWDRDTAWHAGNWDANLTSIGIEHADCSSNPWRISDVCLENGAHLVAALCVYYKLGRPEWGKNIFGHSHFSPTECPASIAGNQRETYMARARYWYDQMTGNSSTPAPNPATATPNIDALADAVIRGDYGNGDTRRARLGSLYDAVQKRVNEKLGAAPAPAAPNIDALADAVIRGDYGNGDERRRRLGSLYDAVQARVNQKLS

SEQ ID NO: 378 - protein, 277 aa, unidentified
  REGION 1..277: note = Bowdeniella nasicola
MKNWLALEADIDLIMNTHYTPGRNGRRIDKVIIHHNAGNLTIKGCYDVWQSRPASAHYQVQTDGRVGQLVWDRDTAWHAGNFAANTTSIGIEHADMASDPWTVSEACLDNGAHLVAAVCKFYGLGRPAWGKNVFGHKDFSATACPASLAGSQHAAYMARAQSWYDQMTGTATTPVPAPAPAPAAPNIDALADAVIRGEYGNGDERKRRLGTNYAAVQARVNEKLLGNAPAPKPAGPNIDALADAVIRGDYGNGEERKRRLGNLYSAVQARVNAKLGY

SEQ ID NO: 379 - protein, 274 aa, unidentified
  REGION 1..274: note = Corynebacterium silvaticum
MKNWNTLEADIDLIMNKHYTPGRNGRKIDKVIIHHNAGNLTIRGCWDVWQTRQASAHYQVQSDGTIGQLVWDSDTAWHAGNWDANTTSIGIEHADATTTPWSVSQACLDNGAHLVAAICKYYKLGRPAWGKNVFGHSHFSATACPASLAGTQHQAYMARAGYWYDQMSGTTPTPKPQPTPAPAPNIDALADAVIRGDYGNGEERKRRLGANYAAVQKRVNEKLAGKTTTKPSVNIDALADAVIRGEYGNGDERRRRLGANYAAVQKRVNQKLGY

SEQ ID NO: 380 - protein, 265 aa, Bifidobacterium choerinum
MGYQYLTQYDAACYTPGRPYGIDSITIHWWDDPAKHPTFDGVVNTFVTGARQTSAHYVAEAGKVACLVAPGDRAWACGDDVNVNSGGNDRSISIECNPRQSDGDYDTIAQLIADLRATYGDLPLYPHRHWSSTGCPGTYDLARLDRLARTKSGKKPAASTPARPAANPAPARKDLDTVAREVIAGQWGNNPERAAKLRAAGYDADAVQARVNQMLGARPTPAPSVDIDALARAVIRGDYGNGDERRRRLGSNYDAVQRRVNQMLG

SEQ ID NO: 381 - protein, 281 aa, unidentified
  REGION 1..281: note = Winkia neuii
MKNWLALEADIDLIMNKHYTPGRNGRKIDKVIIHHNAGNLTIRGCYDVWQTRPASAHYQVQSDGRIGQLVWDRDTAWHAGNFAANTTSIGIEHADVSSNPWAVSEACLDNGAHLVAAICKFYGLGRPAWGKNVFGHKDFSATACPASLAGSQHAAYMAKAQSWYDQMTGSAPAPAPAAPNIDALADAVIRGEYGNGDERKRRLGANYAAVQARVNEKLSGNAPTPTPAPAPAPAPAPATPNIDALADAVIRGEYGNGEERKRRLGNLYSAVQARVNAKLGY

SEQ ID NO: 382 - protein, 280 aa, unidentified
  REGION 1..280: note = Actinomycetes
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTPPAKPTPPAPKPSANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 383 - protein, 280 aa, unidentified
  source 1..280: note = Trueperella bialowiezensis
MKNWDTLDADVNQIMNKHYTKGRSGRRINKVIIHHNAGNLTIKGCWDVWQTRPASAHYQVETSGRIGQLVWDSDTAWHAGNWDANTTSIGIEHADATTNPWSVSQACLDNGAHLVAAICKYYKLGRPQWGKNVFGHSHFSATACPASLAGTQHQAYMARAQYWYDQMTGHTPAPTPKPQPAPAPAPVNIDALADAVIRGEYGNGDERKRRLGANYAAVQARVNQKLGATPRTPAPAPAVNIDALADAVIRGEYGNGEERKRRLGSNYAAVQARVNQKLGY

SEQ ID NO: 384 - protein, 268 aa, Bifidobacterium pseudolongum
MTYQYLTQYDAACYTPGRPYGIDSITIHWWDDPAKHPTFDGAVNTFVTGARQTSAHYVAEAGKVACLVDPDNRAWACGDGVDVGSGGNDKSISIECNPRQSDGDYDTIAQLIADLRATYGDLPLYPHRHWSSTGCPGTYDLNRLDRLARAKRGQKPAASAPARPAAKPKPAPARKDLDAVAREVIAGQWGNNPQRAEKLRAAGYDANAVQARVNQMLGATAAPSRPAVDIDALARAVIRGDYGNGDERRRRLGSNYDAVQRRVNQMLG

SEQ ID NO: 385 - protein, 274 aa, unidentified; identical to SEQ ID NO: 114
  REGION 1..274: note = Corynebacterium silvaticum

SEQ ID NO: 386 - protein, 282 aa, unidentified
  REGION 1..282: note = Scrofimicrobium canadense
MKNWNTLEADVDLIMNKHYTAGRGGRRIDKVIIHHNAGNLTIRGCYDVWQNRQASAHYQVQSDGKIGQLVWDRDTAWHAGNWNANTTSIGIEHADISSKPWRVSDACLDNGAHLVAAICRYYKLGRPAWGKNVFGHKNFSSTECPASLAGSQHAAYMARAQYWYDHMTGTNPAKPAPAKPAPSTPQNIDALADAVIRGDYGNGEERKRRLGSNYAAVQKRVNEKLAGSAPKPSAPKPAPSVNIDALADAVIRGDYGNGDERKRRLGSNYAAVQKRVNQKLGY

SEQ ID NO: 387 - protein, 325 aa, Corynebacterium diphtheriae
MKNWLALEADIDLIMNKHYTHGRNGRKIDKVIIHHNAGNLTIKGCYDVWQSRPASAHYQVQTDGRIGQLVWDRDTAWHAGNFAANTTSIGIEHADASSNPWAVSEACLDNGAHLVAAICKFYGLGRPAWGKNVFGHKDFSATACPASLAGSQHAAYMARAQSWYDQMTGSAPAPAPAAPNIDALADAVIRGEYGNGDERKRRLGANYAAVQARVNEKLSGNAPTPTPAPAPATPNIDALADAVIRGDYGNGDERKRRLGANYAAVQQRVNEKLSGRTPAKPAAPNIDALADAVIRGEYGNGEERKRHLGNLYGAVQARVNAKLGY

SEQ ID NO: 388 - protein, 280 aa, Corynebacterium diphtheriae
MKNWATLEADENRLMNKHYSAGRSGRKINKVIIHHNAGNLTIKSIWDVWQTRQASAHYQVDSGGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTPPAKPTPPAPKPYANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 389 - protein, 373 aa, unidentified
  REGION 1..373: note = Trueperella pecoris
MKNWNTLEADIDLIMNTHYTPGRNGRRIDKVIIHHNAGNLTIRGCHDVWQTRPASAHYQVQTDGRIGQLVWDRDTAWHAGNFAANTTSIGIEHADASSNPWAVSEACLDNGAHLVAAVCKFYGLGRPQWGKNVFGHKDFSPTACPASLAGSQHTAYMARAQSWYDQMTGSAPAPAPATPNIDALADAVIRGEYGNGDERKRRLGANYAAVQQRVNEKLSGNASALKPAGPNIDALADAVIRGDYGNGEERKRHLGANYVAVQQRVNEKLSGNASALKPAGPNIDALADAVIRGEYGNGEERKRRLGANYVAVQQRVNEKLSGNASALKPAGPNIDALADAVIRGEYGNGEERKRRLGANYVAVQARVNAKLGY

SEQ ID NO: 390 - protein, 280 aa, unidentified
  REGION 1..280: note = Gulosibacter hominis
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGDYGNGEERKRRLGSNYAAVQKRVNEKLAGRSPAKPSVNIDALADAVIRGDYGNGEERKRRLGANYAAVQKRVNEKLGIG

SEQ ID NO: 391 - protein, 275 aa, unidentified
  REGION 1..275: note = Actinomycetes
MKNWLALEADIDLIMNKHYTPGRNGRRIDKVIIHHNAGNLTIRGCYDVWQTRPASAHYQVQSDGRIGQLVWDRDTAWHAGNFAANTTSIGIEHADVSSNPWAVSEACLNNGAHLVAAICKFYGLGRPAWGKNVFGHKDFSATACPASLAGSQHAAYMAKAQSWYDQMTGSAPAPAPAAPNIDALADAVIRGEYGNGDERKRRLGANYAAVQARVNEKLSGNAPTPTPAPAPATPNIDALADAVIRGEYGNGEERKRRLGNLYSAVQARVNAKLGY

SEQ ID NO: 392 - protein, 280 aa, Corynebacterium striatum
MKNWATLEADENRLMNKHYTKGRNGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTAPAKPTPPAPKPSANIDALADAVIRGEYGNGDERKRRLGANYAAVQKRVNEKLTGGNPTKPSVNIDALADAVIRGDYGNGEERKRRLGGNYAAVQKRVNEKLGIS

SEQ ID NO: 393 - protein, 75 aa, Helcobacillus massiliensis
MARAQYWYDRMSGTKPAPTPPAKPTPPAPKPSANIDALADAVIRGEYGNGDERKRRLESNYAAVQKRVNEKLGIS

SEQ ID NO: 394 - protein, 125 aa, unidentified
  REGION 1..125: note = Corynebacterium sp. HMSC074A09
MARAQYWYDRMSGTKPAPPTAPARSTPPTPKPSANIDALADAVIRGEYGNGEERKRRLGANYAAVQKRVNEKLTGGNPTKPSVNIDALADAVIRGDYGNGEERKRRLGGNYAAVQKRVNDKLGIS

SEQ ID NO: 395 - protein, 278 aa, Corynebacterium striatum
MKNWATLEADENRLMNKHYSTGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPTWGKNVFGHKHFSSTECPASLAGSQHAAYMARAQYWYDRMSGTKPAPTPPAKPTPPKPSANIDALADAVIRGEYGNGEERKCRLGGNYAAVQKRVNEKLAGGSPTRPSVNIDALADAVIRGEYGNGEERKRRLGGNYAAVQKRVNEKLGIG

SEQ ID NO: 396 - protein, 275 aa, unidentified
  REGION 1..275: note = Arcanobacterium canis
MKNWNTLDADENQILATHFTPGRSGRRIDKIIIHHNAGNLTIAGCYQVWQTRPASAHYQVDSNGRIGQLVWDRNTAWHAGNWEANTTSIGIEHADISSNPWAVSEACLNNGAHLVAAICKFYGLGRPAWGKNVFGHKDFSATACPASLAGSQHAAYMAKAQSWYDQMTGSAPAPAPAAPNIDALADAVIRGEYGNGDERKRRLGANYAAVQARVNEKLSGNAPTPTPAPAPATPNIDALADAVIRGEYGNGEERKRRLGNLYSAVQARVNAKLGY

SEQ ID NO: 397 - protein, 270 aa, Varibaculum cambriense
MKNWLALEADIDLIMNKHYTPGRNGRRIDKVIIHHNAGNLTIRGCYDVWQTRPASAHYQVQSDGRIGQLVWDRDTAWHAGNFAANTTSIGIEHADVSSNPWAVSEACLDNGAHLVAAICKFYGLGRPVWGKNVFGHKDFSATACPASLAGSQHAAYMARAQSWYDQMTGSAPAPAPAAPNIDALADAVIRGEYGNGDERKRRLGANYAAVQQRVNEKLSGRTPAKPAAPNIDALADAVIRGDYGNGEERKRRLGNLYGAVQARVNAKLGY

SEQ ID NO: 398 - protein, 231 aa, Corynebacterium amycolatum
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGEYGNGEERKRRLGANYAAVQKRVNEKLGIS

SEQ ID NO: 399 - protein, 274 aa, unidentified
  REGION 1..274: note = Propionimicrobium lymphophilum
MKNWNSLDADINLLLECHYTKGRQGRTIDKIVLHHNAGNLSVRGCFETWQTRQASAHYQVQSDGLIGQLVWDGDTAWHAGNWEANLTSIGIEHADASSNPWRISQACLENGAHLVAALCVYYRLGRPEWGRNVYGHNHFSPTECPASIAGSQRAAYMARAQYWYDHMTGSAPAPASAKPAPSTPNIDALADAVIRGDYGNGEERKRRLGSNYAAVQKRVNEKLAGRAPAKLGPNIDTLADAVIRGEYGNGEERKRRLGNLYSAVQARVNAKLGY

SEQ ID NO: 400 - protein, 273 aa, Corynebacterium striatum
MKNWLALEADIDLIMNTHYTPGRNGRRIDKVIIHHNAGNLTIRGCYDVWQSRPASAHYQVQTDGRIGQLVWDRDTAWHAGNFAANTTSIGIEHADVSSDPWSVSDACLDNGAHLVAAVCKFYGLGRPQWGKNVFGHKDFSATACPASLAGSQHAAYMARAQSWYDQMTGTAPAPAPVPAAPNIDALADAVIRGEYGNGDERKRRLGANYAAVQQRVNEKLSGNAPAAKLAGPNIDALADAVIRGDYGNGEERKRRLGANYAAVQARVNAKLGY

SEQ ID NO: 401 - protein, 281 aa, Arcanobacterium hippocoleae
MKNWNTLEADIDLIMNKHYTPGRNGRRIDKVIIHHNAGNLTIKGCYDVWQTRPASAHYQVQTDGRIGQLVWDRDTAWHAGNWDANTTSISIEHADVSSDPWSVSEACLDNGAHLVAAICKFYGLGRPVWGKNVFGHKDFSATSCPASLAGSQHATYMARAQYWYDQMTGNTPAPAPAPAPNPAPAPVAPNIDALADAVIRGEYGNGEERKRRLGANYTAVQQRVNEKLAGRAPAANPAGPNIDALADAVIRGDYGNGEERKRRLGNLYNAVQARVNAKLGY

SEQ ID NO: 402 - protein, 276 aa, unidentified
  REGION 1..276: note = Gleimia hominis
MKNWDTLEADQNLILSKHYTPGRNGRRIDKVIIHHNAANLSIQGCYDVWQNRPASAHYQVQSNGRIGQLVWDRDTAWHAGHWDANITSIGIEHADTSSNPWIVSEACLDNGAHLVAAVCKHYSLGRPQWGKNVYGHRDFTATECPASLAGSQHKAYMTRAGAWYDHMSGNTPAPAPAKPTPAAPNIDALADAVIRGEYGNGEERKNRLGSNYAAVQARVNEKLTGKASAAKPAGPNIDALADAVIRGEYGNGNERKRRLGNLYTAVQARVNTKLGY

SEQ ID NO: 403 - protein, 124 aa, unidentified
  REGION 1..124: note = Gulosibacter sp. GYB002
MARAQYWYDRMSGTKPAPTPPAKPTPPAPKPSANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 404 - protein, 280 aa, Dermabacter hominis; identical to SEQ ID NO: 342

SEQ ID NO: 405 - protein, 277 aa, Arcanobacterium hippocoleae
MKNWNTLEADIDLIMNKHYTPGRNGRRIDKVIIHHNAGNLTIKGCYDVWQTRPASAHYQVQTDGRIGQLVWDRDTAWHAGNWDANTTSIGIEHADVSSDPWSVSEACLDNGAHLVAAICKFYGLGRPAWGKNVFGHKDFSATACPASLVGSQHAAYMARAQYWYDQMTGNTPAPAPNPAPAPAAPNIDALADAVIRGEYGNGDERKRRLGANYAAVQQRVNEKLAGRAPAANPAAPNIDALADAVIRGDYGNGEERKRRLGNLYAAVQARVNAKLGY

SEQ ID NO: 406 - protein, 281 aa, Arcanobacterium hippocoleae
MKNWNTLEADIDLIMNKHYTPGRNGRRIDKVIIHHNAGNLTIKGCYDVWQTRPASAHYQVQTDGRIGQLVWDRDTAWHAGNWDANTTSIGIEHADVSSDPWSVSEACLDNGAHLVAAICKFYGLGRPVWGKNVFGHKDFSATSCPASLAGSQHATYMARAQYWYDQMTGNTPAPAPAPAPNPAPAPVAPNIDALADAVIRGEYGNGEERKRRLGANYTAVQQRVNEKLAGRAPAANPAGPNIDALADAVIRGDYGNGEERKRRLGNLYNAVQARVNAKLGY

SEQ ID NO: 407 - protein, 266 aa, Trueperella pyogenes
MLAKHYTAGRGGRKIDKIIIHHNAGNLTIPGIWDVWQTRPASAHYQVDSAGRIGQLVWDRNTAWHEGNWDANTTSIGIEHADISSNPWRISDACLEEDAHLTAAVCKYYGLGRPQWGKNVYGHKHFSPTECPASLAGTQHAAYMARAQYWYDQMTGKAPAPKLKAPTAPAPKPAPSVNIDALADAVIRGEYGNGEERKRRLGANYAAVQKRVNEKLAGNTSKPSVNIDALADVVIRGEYGNGDKRKRRLGANYAAVQKRVNQKLGY

SEQ ID NO: 408 - protein, 279 aa, Trueperella pyogenes
MKNWNTLEADENRILAKHYTAGRGGRSINKVIIHHNAGNLTIPGIYEVWQTRRASAHYQVDSQGRIGQLVWDSDTAWHAGNWDANTTSIGIEHADISSNPWRISDACLEEGAHLTAAVCKYYGLGRPQWGKNVFGHKHFSPTECPASLAGTQHAAYMARAQYWYDQMTGKVPAPKPKVPTAPAPKPAPSVSIDALADAVIRGEYGNGNEGKRRLGANYAAVQKRVNEKLAGNTSKPSANIDALADAVIRGEYGNGEERKRRLGANYAAVQKRVNQKLGY

SEQ ID NO: 409 - protein, 280 aa, Trueperella pyogenes
MKNWATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSANIDALADAVIRGEYGNGEERKRRLGANYAAVQKRVNEKLTGGNPTKPSVNIDALADAVIRGDYGNGEERKRRLGANYAAVQKRVNEKLGIS

SEQ ID NO: 410 - protein, 274 aa, unidentified; identical to SEQ ID NO: 379
  REGION 1..274: note = Corynebacterium silvaticum

SEQ ID NO: 411 - protein, 239 aa, unidentified
  REGION 1..239: note = Enorma burkinafasonensis
MAARKPRRVRITRRNSRSKSSRKTQQGQSQVGGEASDYEKQIAERDEKIASLEAQVAEAAKNAETAEQLHSEIAELKAQGESDRIDFKLQLAGVRNVKAARALLADHGNDVDKLKEAEPWLFEATGKHAKGGNGGSGTTGLPNAGAASDEGKTLKHWREIAGEFGNGDERRRRLGSNYDAVQRRVNEILLGTGSSSTSMDVDAMARAVIRGDYGSGEERRRRLGSYYSIVQARVNEMLS

SEQ ID NO: 412 - protein, 156 aa, Streptococcus agalactiae
SPWAVSEACLDNGAHLVAAICKFYGLGRPQWGKNVFGHKNFSATACPASLAGSQHAAYMSRAQSWYDQMSGSAPAPAPAAPNIDALADAVIRGEYGNGEERKLRLGANYAAVQARVNEKLSGNAPAAKPAGPNIDALADAVIRGDYGNGEERKRRL

SEQ ID NO: 413 - protein, 86 aa, unidentified
  REGION 1..86: note = Pauljensenia sp. UMB0018B
APAPAPAAPNIDALADAVIRGEYGNGEERKLRLGANYAAVQARVNEKLSGNAPAAKPAGPNIDALADAVIRGDYGNGEERKRRLGN

SEQ ID NO: 414 - protein, 226 aa, Dermabacter hominis
MWQTRPASAHYQVQSDGRIGQLVWDCDTAWHAGNWVANTTSIGVEHADVSSNPWAVSEACLDNGAHLVAAVCKFYGLGRPVWGKNVFGHKNFSSTECPASLAGSQHAAYMARAQSWYDQMTGNTPAPAPAPATPNIDALADAVIRGDYGNGEERKRRLGANYAAVQQRVNEKLSGNTPATKPAAPNIDALADAVIRGEYGNGEERKRRLGKLYSAVQARVNAKLGY

SEQ ID NO: 415 - protein, 272 aa, unidentified
  REGION 1..272: note = Actinomycetales bacterium UMB0918
MKNWLALEADIDLIMNKHYTPGRNGRRIDKVIIHHNAGNLTIRGCYDAWQTRPASAHYQVQTDGRIGQLVWDRDTAWHAGNFAANTTSIGIEHADMTSDPWTVSEACLDNGAHLVAAVCKFYGLGRPQWGKNVFGHKDFSATACPASLAGSQHAAYMARAQSWYDQMIGTAPAPAPAPAAPNIDALADAVIRGEYGNGDERKRCLGANYAAVQQRVNEKLSGNAPAKPAGPNIDALADAVIRGEYGNGEERKRRLGNLYNAVQARVNAKLGY

SEQ ID NO: 416 - protein, 229 aa, Corynebacterium diphtheriae
MKNWDTLDADENQILATHFTPGRSGRRIDKIIIHHNAGNLTIAGCYQVWQTRPASAHYQVDSNGRIGQLVWDRNTAWHAGNWEANTTSIGIEHADISSNPWRISDACLDNGAHLVAALCKFYQLGRPTWGKNVFGHKNFSATQCPASLAGTQHAAYMARAQYWYDQMTGKDPVPKQPAKSAPTPAPSVNIDALADAVIRGEYGNGNERKRRLGANYAVVQARVNQKLGY

SEQ ID NO: 417 - protein, 124 aa, Corynebacterium riegelii
MARAQYWYDRMSGTKPAPTPPAKPTPPTPKPSANIDALADAVIRGEYGNGDERKRRLGANYTAVQKLVNEKLTGGNPTKPSVNIDALADAVIRGDCGNGGERKRRLGANYAAVQKRVNEKLGIG

SEQ ID NO: 418 - protein, 280 aa, Corynebacterium striatum
MKNWATLEADENRLMNKHYSAGRSGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSANIDALADAVIRGDYGNGEERKRRLGGNYAAVQKRVNEKLTGRSPTKPSVNIDALADAVIRGDYGNGEERKRRLGANYAAVQKRVNEKLGIG

SEQ ID NO: 419 - protein, 280 aa, Corynebacterium striatum
MKNWATLEADENRLMNKHYSAGRSGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGDYGNGEERKRRLGGNYAAVQKRVNEKLAGRSPAKPSVNIDALADAVIRGDYGNGEERKRRLGANYAAVQKRVNEKLGIG

SEQ ID NO: 420 - protein, 210 aa, Corynebacterium striatum
WDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGDYGNGEERKRRLGGNYAAVQKRVNEKLAGRSPAKPSVNIDALADAVIRGDYGNGEERKRRLGANYAAVQKRVNEKLGIG

SEQ ID NO: 421 - protein, 275 aa, unidentified
  REGION 1..275: note = Collinsella ihumii
NNATYFARNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVAASKWAALKAAITGGVVSGGTTPAAPGGTVAELARRVIAGEFGNGDARRAALGSRYSEVQAEVNRILAGGSSSAPAQPAAPDIEALAQAVIRGDYGNGDDRRAALGSSYDAVQARVNEILGAGGSDGGSGGADIDALARAVIRGEYGNGKERRLRLGSLYDAVQARVNEILL

SEQ ID NO: 422 - protein, 269 aa, Actinomyces sp.
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPVWGKNVFGHRNFSATECPASIAGSQHAAYMARAGYWYDQISGNKPQASSAGKPDIEALANAVIRGEYGNGDQRRARLGSLYDAVQRRVNEKLGTRSAPAAPNIDALADAVIRGEYGNGATRRARLGNLYNQVQARVNQKLGC

SEQ ID NO: 423 - protein, 328 aa, Varibaculum cambriense
MKNWLALEADIDLIMNTHYTPGRNGRKIDKVIIHHNAGNLTIRGCYDVWQSRPASAHYQVQSDGRIGQLVWDRDTAWHAGNFAANTTSIGIEHADVSSNPWAVSEACLDNGAHLVAAVCKFYGLGRPQWGKNVFGHKDFSATACPASLAGSQHTAYMARAQSWYDQMTGNTPAPAPAPAPAPATPNIDTLADAVIRGEYGNGEERKLRLGANYAAVQQRVNEKLSGNASAPKPAGPNIDALADAVIRGDYGNGEERKRRLGANYAAVQQRVNEKLSGNASAPKPAGPNIDALADAVIRGDYGNGEERKRRLGNLYSAVQARVNAKLGY

SEQ ID NO: 424 - protein, 272 aa, Corynebacterium glucuronolyticum
MKNWLALEADIDLIMNKHYTPGRNGRRIDKVIIHHNAGNLTIRGCYDVWQTRPASAHYQVQTDGRIGQLVWDRDTAWHAGNFAANTTSIGIEHADMTSDPWTVSEACLDNGAHLVAAVCKFYGLGRPQWGKNVFGHKDFSATACPASLAGSQHAAYMARAQSWYDQMIGTAPAPAPAPAAPNIDALADAVIRGEYGNGDERKRCLGANYAAVQQRVNEKLSGNAPAKPAGPNIDALADAVIRGEYGNGEERKRRLGNLYNAVQARVNAKLGY

SEQ ID NO: 425 - protein, 276 aa, Arcanobacterium sp.
MKDWNNLTADQNLLMNKHYTAGRGGRSINKIVLHHNAGRLSIQECWNVWQTREASAHYQVDVNGRIGQLVWDRDTAWHAGNWEANCTSIGIEHANNHVGNPWTISDATLENGAHLVAALCRYYKLGRPQWGKNVFGHKHFAATSCPGEIAGSQNSKYMTRAQYWYDHMTSGKTPAPTAKSASTPSTDIDALADAVIRGEYGNGGERKQRLGANYTAVQKRVNEKLSGAAPAKPDGPNIDALADAVIRGEYGNGDERKQRLGNLYSAVQARVNQKLG

SEQ ID NO: 426 - protein, 219 aa, unidentified; identical to SEQ ID NO: 117
  REGION 1..219: note = Actinomycetaceae bacterium

SEQ ID NO: 427 - protein, 167 aa, unidentified
  REGION 1..167: note = Actinotignum sanguinis
AHLVAAICKYYGLGRPQWGKNVFGHKDFSATACPASLAGSQRAAYMARAQHWYDQMTGTAPAPAPAPKPAPAPAAPNIDALADAVIRGDYGNGDERKRRLGANYAAVQARVNEKLAGPAPAKPAAPNIDALADAVIRGDYGNGDERKRRLGNLYGAVQARVNQKLGY

SEQ ID NO: 428 - protein, 272 aa, unidentified; identical to SEQ ID NO: 415
  REGION 1..272: note = Actinomycetales bacterium UMB0918

SEQ ID NO: 429 - protein, 283 aa, unidentified; identical to SEQ ID NO: 120
  REGION 1..283: note = Corynebacterium sp. HMSC074H12

SEQ ID NO: 430 - protein, 190 aa, Corynebacterium striatum
  SITE 56: note = misc_feature - Xaa can be any naturally occurring amino acid
MNKVIIHHNAGNLTIKSIWDVWQTRQASAHYQVDSGGRIGQLVWDRDTAWHAGNWXANTTSIGIEHADISSKPWRISEACLDNGAHLVAAICHYYKLGRPVWGKNVFGHKHFSAYMARAQYWYDRMSGTKPAPTPPAKPTPPTPKPSAYIDALADAVIRGDYGNGEERKRRLGANYAAVQKRVNEKLGIG

SEQ ID NO: 431 - protein, 280 aa, unidentified
  REGION 1..280: note = Corynebacterium
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPAPKPSANIDALADAVIRGDYGNGEERKRRLGGNYAAVQKRVNEKLAGRSPAKPSVNIDALADAVIRGDYGNGEERKRRLGANYAAVQKRVNEKLGIG

SEQ ID NO: 432 - protein, 280 aa, Corynebacterium diphtheriae
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPTPKPSVNIDALADAVIRGDYGNGDERKRRLGSNYAAAQKRVNEKLAGRSPAKPSVNIDALADAVIRGDYGNGEERKRRLGTNYAAVQKRVNEKLGIS

SEQ ID NO: 433 - protein, 268 aa, unidentified
  REGION 1..268: note = Propionimicrobium sp. BV2F7
MKNWNSLDADINLLLECHYTKGRQSRTIDKIILHHNAGNLSVRGCFETWQTRQASAHYQVQSDGLIGQLVWDGDTAWHAGNWEANLTSIGIEHADVSSSPWRISDACLENGAHLVAALCVYYKLGRPEWGRNVYGHSHFSSTECPASIAGNQRAAYMARAGFWYDQMSGNKPAPTPAPNVPNIDVLADAVIRGEYGNGDTRRARLGGLYDAVQRRVNEKLGAGSSSGANIDALADAVIRGDYGNGDERRHRLGSLYDAVQARVNQKLS

SEQ ID NO: 434 - protein, 276 aa, Corynebacterium vitaeruminis
MKNWNTLEADVDLIMNKHYTAGRGGRRIDKVIIHHNAGNLTIRGCYDVWQNRQASAHYQVQSDGKIGQLVWDRDTAWHAGNWNANTTSIGIEHADVSSSPWRVSDACLDNGTHLVAAICRYYKLGRPAWGKNVFGHKNFSATECPASLAGSQHAAYMARAQYWYDHMTGSKPAPAKPKPAPTPAVNIDALSDAVIRGDYGNGEERKRRLGANYAAVQRRVNEKLAGRTPAKPSGPNIDALADAVIRGDYGNGEERKRRLGNLYSQVQKRVNQKLGY

SEQ ID NO: 435 - protein, 273 aa, unidentified
  REGION 1..273: note = Actinomycetes
MKNWLALEADIDLIMNKHYTPGRNGRRIDKVIIHHNAGNLTIKGCYDVWQTRPASAHYQVQSDGRIGQLVWDCDTAWHAGNWVANTTSIGVEHADVSSNPWAVSEACLDNGAHLVAAVCKFYGLGRPVWGKNVFGHKNFSSTECPASLAGSQHAAYMARAQSWYDQMTGNTPAPAPAPATPNIDALADAVIRGDYGNGEERKRRLGANYAAVQQRVNEKLSGNTPATKPAAPNIDALADAVIRGEYGNGEERKRRLGKLYSAVQARVNAKLGY

SEQ ID NO: 436 - protein, 216 aa, Corynebacterium vitaeruminis
RIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTAPAKPTPPAPKPSANIEALADAVIRGEYGNGEERKRRLGANYAAVQKRVNEKLAGRSPAKPSVNIDALADAVIRGDYGNGEERKRRLGGNYAAVQKRVNEKLGIH

SEQ ID NO: 437 - protein, 270 aa, Corynebacterium atypicum
MKNWFALEADIGLIMNKHYTPGRNGRRIDKVIIHHNAGNLTIKGCYDVWQTRPASAHYQVQSDGRIGQLVWDRDTAWHAGNWVANTTSIGIEHADMTSDSWAVSEACLDNGAHLVAAVCKFYGLGRPVWGKNVFGHKNFSSTECPASLAGSQHAAYMARAQSWYEQMTGNTPVPAPATPDIDALADAVIRGDYGNGDERKRRLGANYAAVQQRVNEKLSGRTPTKPAGPNIDALADAVIRGEYGNGEERKRRLGNLYSAVQARVNAKLGY

SEQ ID NO: 438 - protein, 271 aa, unidentified
  REGION 1..271: note = Actinomycetaceae
MKNWLALEADIDLIMNTHYTPGRNGRRIDKVIIHHNAGNLTIRGCYDVWQTRPASAHYQVQTDGTIGQLVWDRDTAWHAGNFAANTTSIGIEHADVSSSPWAVSEACLDNGAHLVAAICKFYGLGRPQWGKNVFGHKNFSATACPASLAGSQHAAYMSRAQSWYDQMSGSAPAPAPAAPNIDALADAVIRGEYGNGEERKLRLGANYAAVQARVNEKLSGNAPAAKPAGPNIDALADAVIRGDYGNGEERKRRLGNLYAAVQARVNAKLGY

SEQ ID NO: 439 - protein, 272 aa, unidentified
  REGION 1..272: note = Corynebacterium sp. HMSC29G08
MKNWLALEADIDLIMNKHYTPGRNGRRIDKVIIHHNAGNLTIRGCYDVWQTRPASAHYQVQTDGRIGQLVWDRDTAWHAGNFAANTTSIGIEHADMTSDPWTVSEACLDNGAHLVAAVCKFYGLGRPQWGKNVFWHKDFSATACPASLAGSQHAAYMARAQSWYDQMIGTAPAPAPAPAAPNIDALADAVIRGEYGNGDERKRCLGANYAAVQQRVNEKLSGNAPAKPAGPNIDALADAVIRGEYGNGEERKRRLGNLYNAVQARVNAKLGY

SEQ ID NO: 440 - protein, 280 aa, Corynebacterium striatum
MKNWATLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWGKNVFGHKHFSATECPASLAGSQHAAYMARAQYWYDRMSGTKPAPTPPAKPTPPAPKPSANIDALADGVIRGEYGNGEERKRRLGANYAAVQKRVNEKLAGGSPAKPSVNIDALADAVIRGDYGNGEERKRRLGANYAAVQKRVNEKLGIG

SEQ ID NO: 441 - protein, 269 aa, unidentified
  REGION 1..269: note = Schaalia turicensis
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPCWGKNIFGHRDFSATECPASIAGSQHATYMARAIYWYDQISGNKPQASSAGKPDIEALANAVIRGEYGNGDQRRARLGSLYDAVQRRVNEKLGAKSAPAAPNIDALADAVIRGDYGNGATRRARLGNLYNQVQARVNQKLGC

SEQ ID NO: 442 - protein, 269 aa, Corynebacterium pyruviciproducens
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPTWGKNVFGHRDFSATECPASIAGSQHATYMARAGYWYDQISGNKPQASSAGKPDIEALANAVIRGEYGNGDQRRARLGSLYDAVQRRVNEKLAAGSAPAAPNIDALADAVIRGDYGNGATRRARLGNLYNQVQARVNQKLGC

SEQ ID NO: 443 - protein, 270 aa, unidentified
  REGION 1..270: note = Gleimia hominis
MKNWLALEADIDLIMNTHYTPGRNGRRIDKVIIHHNAGNLTIRGCYDVWQSRPASAHYQVQTDGRIGQLVWDRDTAWHAGNFAANTTSIGIEHADVSSDPWSVSDACLDNGAHLVAAVCKFYGLGRPVWGKNVFGHKNFSSTECPASLAGSQHTAYMARAQSWYEQMTGNTPVPAPATPDIDALADAVIRGDYGNGDERKRRLGANYAAVQQRVNEKLSGRTPTKPAGPNIDALADAVIRGDYGNGEERKRRLGNLYSAVQARVNAKLGY

SEQ ID NO: 444 - protein, 269 aa, unidentified
  REGION 1..269: note = Varibaculum vaginae
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPVWGKNVFGHRDFSATECPASIAGSQHAAYMARAGYWYDQMSANKPHPPSAGKPDIEALANAVIRGEYGNGDQRRARLGSLYDAVQRRVNEKLGARSAPAAPNIDALADAVIRGDYGNGATRRARLGNLYNQVQARVNQKLGC

SEQ ID NO: 445 - protein, 280 aa, unidentified
  REGION 1..280: note = Trueperella pecoris
MKNWTTLEADENRLMNKHYSAGRSGRKINKVIIHHNAGNLTIKSIWDVWQTRQASAHYQVDSNGRIGQLVWDRDTAWHAGNWEANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPTPKPSANIDALADAVTRGDYGNGEERKRRLGANYAAVQKRVNEKLAGVSPAKPSVNIDALADAVIRGDYGNGEERKRRLGANYAAVQKRVNEKLGIG

SEQ ID NO: 446 - protein, 280 aa, unidentified
  REGION 1..280: note = Trueperella pecoris
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGEYGNGEERKRRLGANYATVQKRVNEKLAGGSPAKPSVNIDALADAVIRGDYGNGEERKRRLGTNYAAVQKRVNEKLGIS

SEQ ID NO: 447 - protein, 272 aa, unidentified
  REGION 1..272: note = Actinomycetaceae
MKNWLALEADIDLIMNKHYTPGRNGRRIDKVIIHHNAGNLTIRGCYDVWQTRPASAHYQVQTDGRIGQLVWDRDTAWHAGNFAANTTSIGIEHADMTSDPWTVSEACLDNGAHLVAAVCKFYGLGRPQWGKNVFGHKDFSATACPASLAGSQHAAYMARAQSWYDQMIGTAPAPAPVPAAPNIDALADAVIRGEYGNGDERKRCLGANYAAVQQRVNEKLSGNAPAKPAGPNIDALADAVIRGEYGNGEERKRRLGNLYNAVQARVNAKLGY

SEQ ID NO: 448 - protein, 155 aa, unidentified
  REGION 1..155: note = Pseudoglutamicibacter cumminsii
MGNVRRRHGSTHCIASTECPASLAGSQHAAYMARAQYWYDRMSGTKPAPTPPAKPTPPTPKPSANIDALADAVIRGEYGNGDERKRRLGANYTAVQKLVNEKLTGGNPTKPSVNIDALADAVIRGDCGNGGERKRRLGANYAAVQKRVNEKLGIG

SEQ ID NO: 449 - protein, 124 aa, unidentified
  REGION 1..124: note = Corynebacterium sp. HMSC30G07
MARAQYWYDRMSGTKPAPTPPAKPTPPTPKPSANIDALADAVIRGEYGNGDERKRRLGANYTAVQKLVNEKLTGGNPNKPSVNIDALADAVIRGDYGNGEERKRRLGANYAAVQKRVNEKLGIS

SEQ ID NO: 450 - protein, 469 aa, unidentified
  REGION 1..469: note = Corynebacterium sp. HMSC074H12
MPLEISTLPISAILPADYNPRKDLQPGDAEYEKLKASIEKFGYVELVVVNKRNDYTAISGHQRLKVLADLGIQEIECVVVDLDENQEKALNIAMNKISGEWDEPKLALLIADLQTADFDVNLTGFDTDEIEALLSLGAEREVTDDGFDLNAALEEAAFVQEGDLWTLGEHKLLCGDATKAEDVERLMGGKQATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNCAHLVAAICHYYKLGRPVWGKNVFGHKHFSATECPASLAGSQHAAYMARAQYWYDRMSGTKPAPTPPAKPTPPAPKPSVNIDALADAVIRGEYGNGEERKRKRRLGSNYAAVQKRVNEKLTGGNPNKPSVNIDALADAVIRGDYGNGEERKRRLGGNYAAVQKRVNEKLGIS

SEQ ID NO: 451 - protein, 250 aa, Corynebacterium striatum
  SITE 57: note = misc_feature - Xaa can be any naturally occurring amino acid
  SITE 116: note = misc_feature - Xaa can be any naturally occurring amino acid
MKNWATLEADENRLMNKHYTKGRSGRKINKVIIHHNAGNLTIKSIWDVWQTRQASAXGRKINKVIIHHNAGNLTIKSIWDVWQTRQASAHYQVDSGGRIGQLVWDRDTAWHAGNWXANTTSIGIEHADISSKPWRISEACLDNGAHLVAAICHYYKLGRPVWGKNVFGHKHFSAYMARAQYWYDRMSGTKPAPTPPAKPTPPTPKPSAYIDALADAVIRGDYGNGEERKRRLGANYAAVQKRVNEKLGIG

SEQ ID NO: 452 - protein, 231 aa, Corynebacterium striatum
MKNWATLEADENRLMNKHYTKGRSGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWGKNVFGHKHFSSTECPASLAGSQHAAYMARAQYWYDRMSGTKPAPTPPAKPTPPTPKPSAYIDALADAVIRGDYGNGEERKRRLGANYAAVQKRVNEKLGIG

SEQ ID NO: 453 - protein, 280 aa, unidentified
  REGION 1..280: note = Corynebacterium
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGDYGNGEERKRRLGGNYAAVQKRVNEKLAGRSPAKPSVNIDALADAVIRGDYGNGEERKRRLGANYAAVQKRVNEKLGIG

SEQ ID NO: 454 - protein, 270 aa, Mobiluncus curtisii
MKNWLALEADIDLIMNKHYTPGRNGRRIDKVIIHHNTGNLTIKGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPATPDIDALADAVIRGDYGNGDERKRRLGANYAAVQQRVNEKLSGRTPTKPAGPNIDALADAVIRGEYGNGEERKRRLGNLYSAVQARVNAKLGY

SEQ ID NO: 455 - protein, 272 aa, Mobiluncus mulieris
MKNWLALEADIDLIMNKHYTPGRNGRRIDKVIIHHNAGNLTIRGCYDVWQTRPASAHYQVQTDGRIGQLVWDRDTAWHAGNFAANTTSIGIEHADMTSDPWTVSEACLDNGAHLVAAVCKFYGLGRPQWGKNVFGHKDFSATACPASLAGSQHAAYMARAQSWYDQMIGTAPAPAPVPAAPNIDALADAVIRGEYGNGEERKLRLGANYAAVQQRVNEKLSGNTPTKPAGPNIDALADAVIRGEYGNGEERKRRLGNLYNAVQARVNAKLGY

SEQ ID NO: 456 - protein, 278 aa, unidentified
  REGION 1..278: note = Actinomycetaceae
MKNWNTLEADIDLIMNKHYTPGRNGRKIDKAIIHHNAGNLTIKGCYDVWQTRPVSAHYQVQTDGRIGQLVWDRDTAWHAGNFAANTTSIGIEHADVSSNPWAVSDACLDNGAHLVAAICKYYGLGRPQWGKNVFGHKDFSATACPASLAGSQRAAYMARAQHWYDQMTGTAPAPAPAPKPAPAPAAPNIDALADAVIRGDYGNGDERKRRLGANYAAVQARVNEKLAGRAPAKPAAPNIDALADAVIRGDYGNGDERKRRLGNLYGAVQARVNQKLGY

SEQ ID NO: 457 - protein, 272 aa, unidentified
  REGION 1..272: note = Actinotignum schaalii
MKNWNTLEADIDLIMNKHYTPGRNGRKIDKAIIHHNAGNLTIKGCYDAWQTRPASAHYQVQTDGRIGQLVWDRDTAWHAGNFAANTTSIGIEHADMTSDPWTVSEACLDNGAHLVAAVCKFYGLGRPQWGKNVFGHKDFSATACPASLAGSQHAAYMARAQSWYDQMIGTAPAPAPAPAAPNIDALADAVIRGEYGNGDERKRCLGANYAAVQQRVNEKLSGNAPAKPAGPNIDALADAVIRGEYGNGEERKRRLGNLYNAVQARVNAKLGY

SEQ ID NO: 458 - protein, 257 aa, unidentified
  REGION 1..257: note = Propionimicrobium lymphophilum
MMNKHFTKGRQGRSINKIILHHNAGNLSVRGCFETWQTRQASAHYQVQSDGLIGQLVWDGDTAWHAGNWDANLTSIGIEHADASSSPWRISDACLENGAHLVAALCKYYGLGRPEWGRNVYGHSHFSPTECPASIAGNQRAAYMARAGYWYDQMTGNKPAQAPAPATATPNVDALADAVIRGDYGNGDTRRARLGGLYDAVQRRVNEKLGAGSSSGSNIDALADAVIRGDYGNGDERRHRLGGLYDAVQRRVNQKLS

SEQ ID NO: 459 - protein, 270 aa, unidentified
  REGION 1..270: note = Actinotignum timonense
MKNWNSLDADINLLLECHYTKGRQGRTIDKIVLHHNAGNMSVRGCVETWQTRQASAHYQVQSDGIIGQLVWDGDTAWHAGNWEANLTSIGIEHADASSNPWRISQACLENGAHLVAALCVYYRLGRPVWGKNVYGHNHFSPTECPASIAGPQRAAYMARAGFWYDQMSGNRPAASKPAAPATANIDALADAVIRGDYGNGDTRRARLGSLYEQVQRRVNEKLGAGSSSGPNIDALADTVIRGDYGNGDERRRRLGGLYDAVQRRVNQKLS

SEQ ID NO: 460 - protein, 124 aa, unidentified
  REGION 1..124: note = Brevibacterium sp. UMB1308A
MARAQYWYDRMSGTKPAPTPPAKPTPPTPKPSANIDALADAVIRGEYGNGDERKRRLGANYTAVQKLVNEKLTGGNPTKPSVNIDALADAVIRGDYGNGEERKRRLGGNYAAVQKRVNEKLGIS

SEQ ID NO: 461 - protein, 270 aa, Trueperella bernardiae
MKNWLALEADIDLIMNKHYTPGRNGRRIDKVIIHHNAGNLTIKGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPATPDIDALADAVIRGDYGNGEERKRRLGANYAAVQQRVNEKLSGNTPTKPAGPNIDALADAVIRGEYGNGEERKRRLGNLYAAVQARVNAKLGY

SEQ ID NO: 462 - protein, 269 aa, Varibaculum cambriense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPVWGKNVFGHRDFSATECPASITGSQHATYMARAGYWYDQISGNKPQASSAGKPDIEALANAVIRGEYGNGDQRRARLGSLYDAVQRRVNEKLAAGSAPAAPNIDALADAVIRGDYGNGATRRARLGNLYNQVQARVNQKLGC

SEQ ID NO: 463 - protein, 316 aa, unidentified
  REGION 1..316: note = Collinsella ihumii
MNIVEFIQASGANYTAGRGGRAIDGMAVHYTATSASAHNNLVYFSRPGAGASAHLFVDKDGAILQSVRLEDTAWAVGDFAENQRTVSVEVVSAGEDFTDAQVAALAEIYAYLRATYGITRVIRHYDVTGKRCPAPYVDAGKWAALRARITGGGFGAAAGGGNGGSAPSGSVAELAQAVIRGDYGNGDARRGALGSRYDEVQAEVNRILGGGTATGGSSSGGAGADIEALAQAVIRGDYGNGDARRAALGASYNAVQARVNEILGAGGSSSGGSGGADIEALAQAVIRGEYGNGDERRRRLGSLYDAVQARVNEILL

SEQ ID NO: 464 - protein, 280 aa, Actinomyces sp.
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWGKNVFGHKHFSATECPASLAGSQHAAYMARAQYWYDRMSGTKPAPTAPAKPTPPAPKPSANIDALADAVIRGDYGNGEERKRRLGGNYAAVQKRVNEKLAGRSPAKPSVNIDALADAVIRGDYGNGEERKRRLGANYAAVQKRVNEKLGIG

SEQ ID NO: 465 - protein, 269 aa, unidentified
  REGION 1..269: note = uncultured Varibaculum sp.
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNVFGHRNFSATECPASIAGSQHAAYMARAGYWYDQISGNKPNPPSAGKPDIEALANAVIRGEYGNGDQRRARLGSLYDAVQRRVNEKLGTRSTPAAPNIDALADAVIRGDYGNGATRRARLGNLYNQVQARVNQKLGC

SEQ ID NO: 466 - protein, 280 aa, unidentified
  REGION 1..280: note = uncultured Mobiluncus sp.
MKNWATLEADENRLMNKHYSAGRSGRKINKVIIHHNAGNLTIKSIWDVWQTRQASAHYQVDSNGRIGQLVWDRDTAWHAGNWDANTTSIGIEHADISSKPWRISEACLDNGAHLVAAICHYYKLGRPVWGKNVFGHKHFSATECPASLAGSQHAAYMARAQYWYDRMSGTKPAPTPPAKPTPPAPKPSANIDALADAVIRGDYGNGEERKRRLGGNYAAVQKRVNEKLAGRSPAKPSVNIDALADAVIRGDYGNGEERKRRLGANYAAVQKRVNEKLGIG

SEQ ID NO: 467 - protein, 272 aa, Varibaculum cambriense
MKNWLALEADIDLIMNTHYTPGRNGRRIDKVIIHHNAGNLTIRGCYDVWQTRPASAHYQVQTDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPAPATPDIDALADAVIRGDYGNGDERKRRLGANYAAVQQRVNEKLSGRTPTKPAGPNIDALADAVIRGEYGNGEERKRRLGNLYGAVQARVNAKLGY

SEQ ID NO: 468 - protein, 273 aa, Actinomyces sp.
MKNWLALEADINLIMNKHYTPGRNGRRIDKVIIHHNAGNLTIKGCYDVWQTRPASAHYQVQSDGRIGQLVWDCDTAWHAGNWVANTTSIGVEHADVSSNPWAVSEACLDNGAHLVAAVCKFYGLGRPVWGKNVFGHKNFSSTECPASLAGSQHAAYMARAQSWYDQMTGNTPAPAPAPATPNIDALADAVIRGDYGNGEERKRRLGANYAAVQQRVNEKLSGNTPATKPAAPNIDALADAVIRGEYGNGEERKRRLGKLYSAVQARVNAKLGY

SEQ ID NO: 469 - protein, 269 aa, unidentified
  REGION 1..269: note = Actinotignum urinale
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNIFGHRDFSATECPASIAGSQHATYMARASYWYDQISGNKPNPPSAGKPDIEALANAVIRGEYGNGDQRRARLGSLYDAVQRRVNEKLAAGSAPAAPNIDALADAVIRGDYGNGATRRARLGNLYNQVQARVNQKLGC

SEQ ID NO: 470 - protein, 226 aa, Dermabacter hominis; identical to SEQ ID NO: 414

SEQ ID NO: 471 - protein, 316 aa, unidentified
  REGION 1..316: note = Enorma phocaeensis
MNIVEFIQASGANYTAGRGGRAIDGMAVHYTATSASAHNNLVYFSRPGAGASAHLFVDKDGAIRQSVRLEDTAWAVGDFAENQRTVSVEVVSAGEDFTDAQVAALAEIYAYLRATYGITRVIRHYDVTGKRCPAPYVDAGKWAALRARITGGGFGAAAGGGNGGSAPSGSVAELAQAVIQGDYGNGDARRGALGSRYDEVQAEVNRILGGGTATGGSSSGGAGADIEALAQAVIRGDYGNGDARRAALGASYDAVQARVNEILGAGGSSSGGSGGADIEALAQAVIRGEYGNGDERRRRLGSLYDAVQARVNEILL

SEQ ID NO: 472 - protein, 279 aa, Corynebacterium amycolatum
MKNWATLEADENRLMNKHYTKGRNGRIINKVIIHHNAGNLTIKSIWDVWQTRQASAHYQVDSNGRIGQLVWDRDTAWHAGNWDANTTSIGIEHADISSKPWRISEACLEEGAHLTAAVCKYYGLGRPQWGKNVFGHKHFSATECPASLAGTQHAAYMARAQYWYDQMTGKAPAPKPKAPTAPAPKPAPSVSIDALADAVIRGEYGNGNERKRRLGNKYAAVQNRVNEKLAGNTSKPSVNIDALADAVIRGEYGNGKERKRRLGANYAAVQKRVNQKLGY

SEQ ID NO: 473 - protein, 280 aa, Trueperella pyogenes
MKNWATLEADENRLMNKHYTKGRNGRKINKVIIHHNAGNLTIKSIWDVWQTRQASAHYQVDSGGRIGQLVWDRDTAWHAGNWDANTTSIGIEHADISSKPWRISEACLDNGAHLVAAICHYYKLGRPVWAKNVFGHKHFSSTECPASLAGSQHAAYMARAQYWYDRMSGTKPAPTPPAKPTPPAPKPSANIDALADAVIRGEYGNGEERKRRLGANYATVQKRVNEKLAGGSPAKPSVNIDALADAVIRGDYGNGEERKRRLGTNYAAVQKRVNEKLGIS

SEQ ID NO: 474 - protein, 227 aa, unidentified
  source 1..227: note = Actinomyces graevenitzii F0530
MKNWNTLEADVDLIMNTHYTPGRNGRQIDKVIIHHNAGNLTIRGCYDVWQTCPASAHYQVQTDGTIGQLVWDRDTAWHAGNFAANTTSIGIEHADMTSDPWTVSEACLDNGAHLVAAVCKYYKLGRPVWGKNVFGHKDFSATACPASLAGSQHAAYMARALYWYDQMTGTALAPAPAPAKPAPAVPNIDALADAVIRGEYGNGAERRNRLGHLYDAVQAIVNRKLGY

SEQ ID NO: 475 - protein, 58 aa, unidentified
  REGION 1..58: note = Candidatus Olsenella avicola
MNRILLGGSTAPAQPAAPDIEALARSVIRGEYGNGEERRRRLGSLYDAVQARVNEILS

SEQ ID NO: 476 - protein, 223 aa, Trueperella bernardiae
MWQTRPASAHYQVQTDGTIGQLVWDRDTAWHAGNFAVNTTSIGIEHADVSSNPWAVSEACLDNGAHLVAAICKFYGLGRPAWGKNVFGHKDFSATACPASLAGSQHAAYMSRAQSWYDQMSGSAPAPAPAAPNIDALADAVIRGDYGNGEERKLRLGANYAAVQQRVNEKLSGNTPTKPAGPNIDALADAVIRGDYGNGEERKRRLGNLYAAVQARVNAKLGY

SEQ ID NO: 477 - protein, 227 aa, Actinomyces graevenitzii
MKNWNTLEADVDLIMNTHYTPGRNGRQIDKVIIHHNAGNLTIRGCYDVWQTCPASAHYQVQTDGTIGQLVWDRDTAWHAGNFAANTTSIGIEHADMTSDPWTVSEACLDNGAHLVAAVCKYYKLGRPVWGKNVFGHKDFSATPCPASLAGSQYAAYMARAQSWYDHMTGSTSAPAPAPAKPAPAVPNIDALADAVIRGEYGNGAERRNRLGHLYDAVQAIVNRKLGY

SEQ ID NO: 478 - protein, 272 aa, unidentified; identical to SEQ ID NO: 121
  REGION 1..272: note = Actinomycetaceae bacterium

SEQ ID NO: 479 - protein, 273 aa, unidentified
  REGION 1..273: note = Actinomycetaceae bacterium
MKNWLALEADIDLIMNTHYTPGRNGRRIDKVIIHHNAGNLTIRGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPAPATPDIDALADAVIRGDYGNGEERKRRLGANYAAIQQRVNEKLSGNTPATKPAAPNIDALADAVIRGEYGNGEERKRRLGNLYSAVQARVNAKLGY

SEQ ID NO: 480 - protein, 227 aa, Actinomyces graevenitzii
MKNWNTLEADVDLIMNTHYTPGRNGRQIDKVIIHHNAGNLTIRGCYDVWQTCPASAHYQVQTDGTIGQLVWDRDTAWHAGNFAANTTSIGIEHADMTSDPWTVSEACLDNGAHLVAAVCKYYKLGRPVWGKNVFGHKDFSATACPASLAGSQYAAYMARAQSWYDHMTGSTSAPAPAPAKPAPAVPNIDALADAVIRGEYGNGAERRNRLGHLYDAVQAIVNRKLGY

SEQ ID NO: 481 - protein, 271 aa, unidentified
  REGION 1..271: note = Coriobacteriales bacterium
RRNYTPGRGGQRVRRVVVHYTGARGNAHENLVYFSRNRCGASAHYFIGKGGDVRQSVRESDTAWHAGNWGMNLMSVGIEVCSAGEDFTEAQVASLASLVGDLMRRYGIPASGVIRHYDVTGKHCPAPYVDAGKWARLHARITGGAATVPAKAAPAGGSGSDGGFLVRVTADALNVRSGPGTQFPKTGCIRDRGTYTVVETRDGWGRLRSGAGWICLNYTTRAGNIGGAKAVDVDALARAVIRGEYGTGAERRRRLGANYEAVQRRVNEILR

SEQ ID NO: 482 - protein, 87 aa, unidentified
  REGION 1..87: note = Parafannyhessea umbonata
RRVIAGEFGNGDERRRRLGSRYAAVQRRVNEILGGGVSGGAARGPVSDVDALARAVIRGDYGNGDERRRRLGSRYAAVQRRVNELLS

SEQ ID NO: 483 - protein, 298 aa, unidentified
  REGION 1..298: note = Actinomycetaceae bacterium UMB1218B
DKVIIHHTAGNLTIRGCYDVWQSRPASAHYQVQTDGTIGQLVWDRDTAWHAGNFAANTTSIGIEHADVSSNPWAVSEACLDNGAHLVAAVCKFYGLGRPAWGKNVFGHKDFIPTACPASLAGSQHTAYMARAQSWYDQMTGNTPAPAPAPAPATPNIDTLADAVIRGEYGNGEERKLRLGANYAAVQQRVNEKLSGNASAPKPAGPNIDALADAVIRGDYGNGEERKLRLGANYAAVQARVNEKLAGRAPAAKPAGPNIDALADTVIRGEYGNGEDRKRRLGNLYSAVQARVNAKLGY

SEQ ID NO: 484 - protein, 160 aa, Actinomyces sp.
AHLVAAVCKFYGLGRPAWGKNVFGHKDFSATACPASLAGSQHAAYMSRAQSWYDQMSGSAPAPAPAAPNIDALADAVIRGDYGNGEERKRCLGANYAAVQQRVNEKLSGNAPAAKPAGPNIDALADAVIRGEYGNGEERKRRLGNLYSAVQARVNAKLGY

SEQ ID NO: 485 - protein, 270 aa, Varibaculum cambriense
MKNWNTLEADIDLIMNTHYTPGRNGRRIDKVIIHHNAGNLTIRGCYDVWQTRPASAHYQVQTDGTIGQLVWDRDTAWHAGNFAVNTTSIGIEHADVSSNPWAVSEACLDNGAHLVAAICKFYGLGRPAWGKNVFGHKDFSATACPASLAGSQHAAYMSRAQSWYDQMSGSAPAPAPAAPNIDALADAVIRGDYGNGEERKLRLGANYAAVQQRVNEKLSGNTPTKPAGPNIDALADAVIRGDYGNGEERKRRLGNLYAAVQARVNAKLGY

SEQ ID NO: 486 - protein, 136 aa, Varibaculum cambriense
FGHRDFSATECPASIAGSQHATYMARAGYWYDQISGNKPNPPSAGKPDIEALANAVIRGEYGNGDQRRARLGGLYDAVQRRVNEKLAAGSAPAAPNIDALADAVIRGEYGNGATRRARLGNLYNQVQARVNQKLGC

SEQ ID NO: 487 - protein, 303 aa, Collinsella sp.
MNIAEFIQCHASNFTKGRGGNAIDGMAVHYTATSASAHNNLVYFSRAGANASAHLFVDKDGTIRQSVRFEDTAWAVGNFPQNQRTVSVEVVSAGEDFTDAQINALAQIYEYLRATYGITRVIRHYDVTGKHCPAPYVNSGKWAALKARITGGSSSSAPSSGSSPSGSVTELAKRVIAGEFGNGDARKAALGSRYDEVQAEVNRILNGGGSSSPSVDIDQMARDVIAGKYGNGDARKAALGSNYDAVQARVNELLGAGGSATGGADIDALARAVIRGEYGNGEERKRRLGSLYDAVQARVNQLL

SEQ ID NO: 488 - protein, 273 aa, Varibaculum cambriense
MKNWLALEADIDLIMNKHYTPGRNGRRIDKVIIHHNAGNLTIKGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPAPATPDIDALADAVIRGDYGNGEERKRRLGANYAAIQQRVNEKLSGNTPATKPAAPNIDTLADAVIRGEYGNGEERKRRLGNLYSAVQARVNAKLGY

SEQ ID NO: 489 - protein, 270 aa, unidentified
  REGION 1..270: note = Actinomycetes
MKNWNTLEADIDLIMNTHYTPGRNGRRIDKVIIHHNAGNLTIRGCYDVWQTRPASAHYQVQTDGTIGQLVWDRDTAWHAGNFAANTTSIGIEHADVSSSPWAVSEACLDNGAHLVAAICKFYGLGRPQWGKNVFGHKDFSATACPASLAGSQHAAYMSRAQSWYDQMSGSAPAPAPAAPNIDALADAVIRGDYGNGEERKLRLGANYAAVQQRVNEKLSGNTPTKPAGPNIDALADAVIRGDYGNGEERKRRLGNLYAAVQARVNAKLGY

SEQ ID NO: 490 - protein, 268 aa, Mobiluncus curtisii
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPVWGKNVFGHRDFSATECPASIAGSQHATYMARAGYWYDQISGNKPQASSAGKPDIEALANAVIRGEYGNGDQRRARLGGLYDAVQRRVNEKLGAGSAPAAPNIDALADAVIRGEYGNGATRRARLGNLYNQVQARVNQILS

SEQ ID NO: 491 - protein, 326 aa, unidentified
  REGION 1..326: note = Lawsonella clevelandensis
MKNWNTLEADIDLIMNTHYTPGRNGRRIDKVIIHHNAGNLTIRGCYDVWQSRPASAHYQVQTDGTIGQLVWDRDTAWHAGNFAANTTSIGIEHADVSSNPWAVSEACLDNGAHLVAAVCKFYGLGRPAWGKNVFGHKDFIPTACPASLAGSQHTAYMARAQSWYDQMTGNTPAPAPAPAPATPNIDTLADAVIRGEYGNGEERKLRLGANYAAVQQRVNEKLSGNASAPKPAGPNIDALADAVIRGDYGNGEERKLRLGANYAAVQARVNEKLAGRAPAAKPAGPNIDALADTVIRGEYGNGEDRKRRLGNLYSAVQARVNAKLGY

SEQ ID NO: 492 - protein, 271 aa, unidentified
  REGION 1..271: note = Actinomycetaceae
MKNWLALEADIDLIMNKHYTPGRNGRRIDKVIIHHNAGNLTIKGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPATPDIDALADAVIRGDYGNGEERKRRLGANYAAIQQRVNEKLSGNTPATKPAAPNIDALADAVIRGEYGNGEERKRRLGNLYSAVQARVNAKLGY

SEQ ID NO: 493 - protein, 271 aa, Varibaculum cambriense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPVWGKNVFGHRDFSATECPASIAGSQHATYMARACYWYDQISGNKPQASSAGKPDIEALANAVIRGEYGNGDQRRARLGGLYDAVQRRVNEKLGFKAKPAGKSIETLAREVIRGDWGNGQERYNRLTNAGYNYQQVQNRVNQILA

SEQ ID NO: 494 - protein, 272 aa, Varibaculum cambriense
MKNWLALEADIDLIMNKHYTPGRNGRRIDKVIIHHNAGNLTIKGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPAPATPDIDALADAVIRGDYGNGEERKRRLGANYAAIQQRVNEKLSGRTPTKPAAPNIDALADAVIRGEYGNGEERKRRLGNLYGAVQARVNAKLGY

SEQ ID NO: 495 - protein, 236 aa, unidentified
  REGION 1..236: note = Actinomyces sp. HMSC065F12
HNAGNLTIRGCYDVWQTRPASAHYQVQTDGTIGQLVWDRDTAWHAGNFAANTTSIGIEHADVSSSPWAVSEACLDNGAHLVAAICKFYGLGRPQWGKNVFGHKDFSATACPASLAGSQHAAYMSRAQSWYDQMSGSAPAPAPAAPNIDALADAVIRGDYGNGEERKLRLGANYAAVQQRVNEKLSGNTPTKPAGPNIDALADAVIRGDYGNGEERKRRLGNLYAAVQARVNAKLGY

SEQ ID NO: 496 - protein, 269 aa, unidentified
  REGION 1..269: note = Varibaculum massiliense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPCWGKNIFGHRDFSATECPASIAGSQHAAYMARAGYWYDQISGNKPNPPSAGKPDIEALANAVIRGEYGNGDQRRARLGGLYDAVQRRVNEKLAAGSAPAAPNIDALADAVIRGEYGNGATRRARLGNLYNQVQARVNQKLGC

SEQ ID NO: 497 - protein, 273 aa, unidentified
  REGION 1..273: note = Varibaculum massiliense
MKNWLALEADIDLIMNKHYTPGRNGRRIDKVIIHHNAGNLTIKGCYDVWQTRPASAHYQVQSDGRIGQLVWDRDTAWHAGNWVANTTSIGIEHADMTSDPWTVSEACLDNGAHLVAAICKFYGLGRPVWGKNVFGHKNFSSTECPASLAGSQHAAYMARAQSWYDQMTGNTPAPAPAPATPDIDALADAVIRGDYGNGEERKRRLGANYAAIQQRVNEKLSGNTPATKPAAPNIDALADAVIRGEYGNGEERKRRLGNLYSAVQARVNAKLGY

SEQ ID NO: 498 - protein, 271 aa, unidentified
  REGION 1..271: note = Actinomycetaceae
MKNWNTLEADIDLIMNTHYTPGRNGRRIDKVIIHHNAGNLTIRGCYDVWQTRPASAHYQVQTDGRIGQLVWDRDTAWHAGNFAANTTSIGIEHADVSSNPWAVSEACLDNGAHLVAAVCKFYGLGRPAWGKNVFGHKDFSATACPASLAGSQHAAYMSRAQSWYDQMSGSAPAPAPAAPNIDALADAVIRGDYGNGEERKRCLGANYAAVQQRVNEKLSGNAPAAKPAGPNIDALADAVIRGEYGNGEERKRRLGNLYSAVQARVNAKLGY

SEQ ID NO: 499 - protein, 315 aa, unidentified
  REGION 1..315: note = Eggerthella
MAYSILFKQCGSDHMTRGRSRAIDRIVVHFTATLASARNNATYFARNEGQGASAHYFVDDITPEIYQSVAEGDTAWHAGNWQMNCRAIGIEVVSAGEDFSATEVEKLGWLVRRLMAKYGIDASGVIRHYDVTGKLCPAPYVTASKWAALKAAITGGAAIPSGGETSAPGGAVAELARRVIAGEFGNGDARRAALGSRYSEVQAEVNRILLGGGSSSAPAQPAAPDIEALAQAVIRGDYGNGDDRRAALGASYDAVQARVNEILGAGGSDGGPGEADIDALARAVIRGEYGNGEERKSRLGSLYDAVQARVNEILL

SEQ ID NO: 500 - protein, 314 aa, unidentified
  REGION 1..314: note = Enorma massiliensis
MAHSILFKQCGSDHMTRGRSRAVDRIVVHFTATLASARNNATYFARNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVAASKWAALKAAITGGAASGGTASAAPGGTVSELARRVIAGEFGNGDARRAALGSRYSEVQAEVNRILGGGSSSVPAQPAAPDIEALAQAVIRGDYGNGDDRRAALGASYDAVQARVNEILGAGGGSSGGSGGADIEALARAVIRGEYGNGEERRSRLGSLYDAVQARVNEILL

SEQ ID NO: 501 - protein, 316 aa, unidentified; identical to SEQ ID NO: 131
  REGION 1..316: note = Collinsella sp. An271

SEQ ID NO: 502 - protein, 314 aa, unidentified
  REGION 1..314: note = Olsenella sp. An293
MAYSVLFKQCGSDHMTRGRSRAVDRIVVHFTATLASARNNATYFARNEGQGASAHYFVDDVTPEIYQSVAEGDTAWHAGNWAMNCRSIGIEVVSAGEDFSTTEVEKLTWLVRKLMTKYGIGASGVIRHYDVTGKLCPAPYVASSKWAALKAAITGGSAPGGTAGAAPGGTASELARRVIAGEFGNGDARRAALGSRYSEVQAEVNRILAGGSGAPATQAPAADDVDDLARRVIAGEFGNGEARRTALGDRYDEVQARVNEMLGAGGSGGTSGGADVDALARAVIRGEYGNGEERRRRLGSLYGAVQARVNEILS

SEQ ID NO: 503 - protein, 269 aa, Varibaculum cambriense
MKNWNTLEADLNLLMNKHFTKGRQGRSINKIILHHNDGNLSIQGCWNVWQTRPASAHYQVETSGRIGQLVWDRDTAWHAGNWVANTTSIGIEHAYASTHPYRISDACLENGAHLLAALCHYYKLGRPCWGKNIFGHRDFSATECPASIAGSQHAAYMARAGYWYDQISGNKPNPPSAGKPDIEALANAVIRGEYGNGDQRRARLGGLYDAVQRRVNEKLAAGSAPAAPNIDALADAVIRGEYGNGATRRARLGNLYNQVQARVNQKLGC

SEQ ID NO: 504 - protein, 315 aa, unidentified; identical to SEQ ID NO: 123
  REGION 1..315: note = Schaalia sp. ZJ405

SEQ ID NO: 505 - protein, 277 aa, unidentified
  REGION 1..277: note = Actinomycetes
MKNWLALEADIDLIMNTHYTPGRNGRRIDKVIIHHNAGNLTIRGCYDVWQSRPASAHYQVQTDGRIGQLVWDRDTAWHAGNFAANTTSIGIEHADVSSDPWSVSDACLDNGAHLVAAVCKFYGLGRPVWGKNVFGHKDFSATACPASLAGSQHAAYMARAQYWYDQMTGATSAPALTPAPAPATPNIDALADAVIRGDYGNGDERKRRLGASYAAVQQRVNEKLSGNAPAAKPAGPNIDALADAVIRGDYGNGEERKRRLGANYAAVQARVNAKLGY

SEQ ID NO: 506 - protein, 323 aa, unidentified
  REGION 1..323: note = Trueperella pecoris
MTFSPLCKHTVSTKNYSSRSGNRITRLIIHYTAGGTDESNVRLLSRSHEYGRDVSCTYVLRRDGSLVGIVPEEYRPWTSGSFSADAPSVTVETVISPKGQATAAQMETLARLAADLSNRYGWGALNRSNIRGHREFAATDCPGPYLWPRMDQIVTRANQLRTGNKPTPAHAPAADIESLADAVIRGEYGNGQERKRKLGSKYSAVQARVNEKLAGKPAPTPKPAAKPAPPTGNIDALADAVIRGEYGNGEDRKRRLGAQYAAVQKRVNEKLAGENTAKPAVNIDALADAVIRGDYGNGEERKRRLGANYAAVQARVNHKLGIR

SEQ ID NO: 507 - protein, 313 aa, unidentified
  REGION 1..313: note = Collinsella sp. An271
MAYSILFKQCGSDHMTRGRSRAIDRIVVHFTATLASARNNATYFARNEGQGASAHYFVDDITPEIYQSVAEGDTAWHAGNWAMNCRAIGIEVVSAGEDFSATEVEKLGWLVKRLMAKYGIGASGVIRHYDVTGKLCPAPYVAASKWAALKAAITGGVVSGGTTPAAPSGTVAELARRVIAGEFGNGDARRAALGGRYPEVQAEVNRILAGGSSPASAQPAAPDIEALAQAVIRGDYGNGDDRRAALGASYDAVQARVNEILGTGGSDGGSGGADIDALAQAVIRGECGNGEERRSRLGSLYDAVQARVNEILL

SEQ ID NO: 508 - protein, 318 aa, Collinsella tanakaei
MNIVEFVQASGANYTAGRGGRAIDGMAVHYTATSASAHNNLVYFSRAGTGASAHLFVDKDGSIRQSVRLEDTAWAVGDFAENQRTVSVEVVSAGEDFTDSQVAALAEIWAFLRATHGVTRLIRHYDVTGKLCPAPYVDAGKWAALKARILGGGGAAVAPGPSGGAPSGSVADLAARVIAGEFGNGDARRAALGSRYDEVQAEVNRILLGGSGSAAPAAAAPAPAAPDIEALAQAVIRGEYGNGDARRAALGANYDAVQARVNEILGVGGGSSGGSGGADIEALAQAVIRGDYGNGEERRRRLGSLYDAVQARVNEILL

SEQ ID NO: 509 - protein, 276 aa, unidentified
  REGION 1..276: note = Pseudoglutamicibacter cumminsii
MKNWLALEADIDLIMNTHYTPGRNGRRIDKVIIHHNAGNLTIRGCYDVWQSRPASAHYQVQTDGRIGQLVWDRDTAWHAGNFAANTTSIGIEHADVSSDPWSVSDACLDNGAHLVAAVCKFYGLGRPVWGKNVFGHKDFSATACPASLAGSQHAAYMARAQYWYDQMTGATSAPALTPAPAPATPNIDALADAVIRGDYGNGDERKRRLGARYAAVQQRVNEKLSGNTPTKPAGPNIDALADAVIRGDYGNGDERKRRLGNLYATVQARVNAKLGY

SEQ ID NO: 510 - protein, 314 aa, unidentified
  REGION 1..314: note = Enorma shizhengliae
MAYSILFKQCGSDHMTRGRSRAIDRIVVHFTATLASARNNATYFSRNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVAASKWAALKAAITDGAASGGTTSAAPGGTVSELARRVIAGEFGNGDARRAALGSRYPEVQAEVNRILGGGSSSVPAQPAAPDIEALAQAVIRGDYGNGDDRRAALGASYDAVQARVNEILGAGGGSSGGSGGADIEALARAVIRGEYGNGEERRSRLGSLYDAVQARVNEILL

SEQ ID NO: 511 - protein, 276 aa, unidentified
  REGION 1..276: note = Dermabacter jinjuensis
MKNWNTLEADIDLIMNTHYTPGRNGRRIDKVIIHHNAGNLTIRGCYDVWQSRPASAHYQVQTDGRIGQLVWDRDTAWHAGNFAANTTSIGIEHADVSSDPWSVSDACLDNGAHLVAAVCKFYGLGRPQWGKNVFGHKDFSATACPASLAGSQHAAYMARAQSWYDQMTGATSAPALTPAPAPATPNIDALADAVIRGDYGNGDERKRRLGASYAAVQQRVNEKLSGNTPTKPAGPNIDALADAVIRGDYGNGDERKRRLGNLYAAVQARVNAKLGY

SEQ ID NO: 512 - protein, 186 aa, unidentified
  REGION 1..186: note = Winkia sp. ACRQY
PTGIEHADMTSDPWTVSEACLDNGAHLVAAICKFYGLGRPVWGKNVFGHKNFSSTECPASLAGSQHAAYMARAQSWYDQMTGNTPAPAPAPATPDIDALADAVIRGDYGNGEERKRRLGANYAAIQQRVNEKLSGNTPATKPAAPNIDALADAVIRGEYGNGEERKRRLGNLYSAVQARVNAKLGY

SEQ ID NO: 513 - protein, 277 aa, unidentified
  REGION 1..277: note = Arcanobacterium pinnipediorum
MKNWTTLEADIDLIMNKHYTKGRNGRRIDKVIIHHNAGNLTIRGCYEVWQSRPASAHYQVQTDGTIGQLVWDRDTAWHAGNFAANTTSIGIEHADVSSDPWSVSEACLDNGAHLVAAICQYYGLGRPTWGKNVFGHCDFSATACPASLAGSQHATYMARAQYWYDQMTGTAVVSAPAPVEPTPAAPNIDALADAVIRGQYGNGEERQRRLGNLYGAVQARVNEKLSGAGLSKPAGPNIDALADAVIRGEYGNGEERKRRLGNLYSAVQARVNQKLGY

SEQ ID NO: 514 - protein, 207 aa, unidentified
  REGION 1..207: note = Dermabacter jinjuensis
MWDRDTAWHAGNFAANTTSIGIEHADVSSDPWSVSDACLDNGAHLVAAVCKFYGLGRPQWGKNVFGHKDFSATACPASLAGSQHAAYMARAQSWYDQMTGATSAPALTPAPAPATPNIDALADAVIRGDYGNGDERKRRLGASYAAVQQRVNEKLSGNTPTKPAGPNIDALADAVIRGDYGNGDERKRRLGNLYAAVQARVNAKLGY

SEQ ID NO: 515 - protein, 276 aa, unidentified
  REGION 1..276: note = Actinomycetaceae
MKNWLALEADIDLIMNTHYTPGRNGRRIDKVIIHHNAGNLTIRGCYDVWQSRPASAHYQVQTDGRIGQLVWDRDTAWHAGNFAANTTSIGIEHADVSSDPWSVSDACLDNGAHLVAAVCKFYGLGRPVWGKNVFGHKDFSATACPASLAGSQHAAYMARAQYWYDQMTGATSAPALTPAPAPATPNIDALADAVIRGDYGNGDERKRRLGASYAAVQQRVNEKLSGNTPTKPAGPNIDALADAVIRGDYGNGDERKRRLGNLYAAVQARVNAKLGY

SEQ ID NO: 516 - protein, 318 aa, unidentified
  REGION 1..318: note = Enorma massiliensis
MNIVEFVQASGANYTAGRGGRAIDGMAVHYTATSASAHNNLVYFSRAGAGASAHLFVDKDGSIRQSVRLEDTAWAVGDFAENQRTVSVEVVSAGEGFTDSQVAALAEIWAFLRATYGVTRLIRHYDVTGKPCPAPYVDAGKWAALKARILGGSGAAVAPGPSGGAPSGSVADLAARVIAGEFGNGDARRAALGSRYDEVQAEVNRILLGGSGSATPAAAAPAPAAPDIEALAQAVIRGEYGNGDARRAALGANYDAVQARVNEILGVGGGSSGGSDGADIEALAQAVIRGDYGNGEERRRRLGSLYDAVQARVNEILL

SEQ ID NO: 517 - protein, 275 aa, unidentified
  REGION 1..275: note = unclassified Pauljensenia
MKNWNTLEADIDLIMNTHYTPGRNGRRIDKVIIHHNAGNLTIRGCYDVWQSRPASAHYQVQTDGTIGQLVWDRDTAWHAGNFAANTTSIGIEHADVSSNPWAVSEACLDNGAHLVAAVCKFYGLGRPAWGKNVFGHKDFIPTACPASLAGSQHTAYMARAQSWYDQMTGNTPAPAPAPAPATPNIDTLADAVIRGEYGNGEERKLRLGANYAAVQARVNEKLAGRAPAAKPAGPNIDALADTVIRGEYGNGEDRKRRLGNLYSAVQARVNAKLGY

SEQ ID NO: 518 - protein, 271 aa, unidentified
  REGION 1..271: note = Winkia sp. UMB10116
MKNWNTLEADIDLIMNTHYTPGRNGRRIDKVIIHHNAGNLTIRGCYDVWQTRPASAHYQVQTDGTIGQLVWDRDTAWHAGNFAANTTSIGIEHADVSSSPWAVSEACLDNGAHLVAAICKFYGLGRPQWGKNVFGHKDFSATACPASLAGSQHAAYMSRAQSWYDQMSGSAPAPAPAAPNIDALADAVIRGDYGNGEERKRCLGANYAAVQQRVNEKLSGNAPAAKPAGPNIDALADAVIRGEYGNGEERKRRLGNLYSAVQARVNAKLGY

SEQ ID NO: 519 - protein, 271 aa, unidentified
  REGION 1..271: note = unclassified Winkia
MKNWNTLEADIDLIMNTHYTPGRNGRRIDKVIIHHNAGNLTIRGCYDVWQTRPASAHYQVQTDGRIGQLVWDRDTAWHAGNFAANTTSIGIEHADVSSNPWAVSEACVDNGAHLVAAVCKFYGLGRPVWGKNVFGHKNFSSTECPASLAGSQHAAYMSRAQSWYDQMSGSAPAPAPAAPNIDALADAVIRGDYGNGEERKRCLGANYAAVQQRVNEKLSGNAPAAKPAGPNIDALADAVIRGEYGNGEERKRRLGNLYSAVQARVNAKLGY

SEQ ID NO: 520 - protein, 271 aa, Bifidobacterium sp.
MKNWLALEADIDLIMNTHYTPGRNGRRIDKVIIHHNAGNLTIRGCYDVWQTRPASAHYQVQTDGRIGQLVWDRDTAWHAGNFAANTTSIGIEHADVSSNPWAVSEACLDNGAHLVAAVCKFYGLGRPAWGKNVFGHKDFSATACPASLAGSQHAAYMSRAQSWYDQMSGSAPAPAPAAPNIDALADAVIRGDYGNGEERKRCLGANYAAVQQRVNEKLSGNAPAAKPAGPNIDALADAVIRGEYGNGEERKRRLGNLYSAVQARVNAKLGY

SEQ ID NO: 521 - protein, 271 aa, unidentified
  REGION 1..271: note = uncultured Varibaculum sp.
MKNWNTLEADIDLIMNTHYTPGRNGRRIDKVIIHHNAGNLTIRGCYDVWQTRPASAHYQVQTDGTIGQLVWDRDTAWHAGNFAANTTSIGIEHADVSSSPWAVSEACLDNGAHLVAAICKFYGLGRPQWGKNVFGHKDFSATACPASLAGSQHAAYMSRAQSWYDQMSGSAPAPAAPAAPNIDALADAVIRGDYGNGEERKLRLGANYAAVQQRVNEKLSGNTPTKPAGPNIDALADAVIRGDYGNGEERKRRLGNLYAAVQARVNAKLGY

SEQ ID NO: 522 - protein, 269 aa, unidentified; identical to SEQ ID NO: 122
  REGION 1..269: note = uncultured Varibaculum sp.

SEQ ID NO: 523 - protein, 318 aa, unidentified
  REGION 1..318: note = uncultured Enorma sp.
MNIVEFVQASGANYTAGRGGRAIDGMAVHYTATSASAHNNLVYFSRAGAGASAHLFVDKDGSIRQSVRLEDTAWAVGDFAENQRTVSVEVVSAGEDFTDSQVAALAEIWAFLRATYGVTRLIRHYDVTGKLCPAPYVDAGKWAALKARILGDSGAAVAPGPSGGAPSGSVADLAARVIAGEFGNGDARRAALGSRYDEVQAEVNRILLGGSGSAAPAAAAPAPAAPDIEALAQAVIRGEYGNGDARRAALGANYDAVQARVNEILGVGGGSSGGSGGADIEALAQAVIRGDYGNGEERRRRLGSLYDAVQARVNEILL

SEQ ID NO: 524 - protein, 313 aa, unidentified
  REGION 1..313: note = Collinsella ihumii
MAYSILFKQCGSDHMTRGRSRAIDRIVVHFTATLASARNNATYFSRNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVAASKWAALKAAITGGVVSGGTTPAAPGGTVAELARRVIAGEFGNGDARRAALGSRYSEVQAEVNRILAGGSSSAPAQPAAPDIEALAQAVIRGDYGNGDDRRAALGSTYDAVQARVNEILGAGGSDGGSGGADIDALARAVIRGEYGNGEERRSRLGPLYDAVQARVNEILL

SEQ ID NO: 525 - protein, 269 aa, unidentified
  REGION 1..269: note = Gleimia europaea
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPCWGKNVFGHRDFSATECPASIAGSQHATYMARAIYWYDQISGNKPNPPSAGKPDIEALANAVIRGEYGNGDQRRARLGGLYDAVQRRVNEKLAAGSAPAAPNIDALADAVIRGDYGNGATRRARLGNLYNQVQARVNQKLGC

SEQ ID NO: 526 - protein, 269 aa, Varibaculum cambriense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNIFGHRDFSATECPASIAGSQHATYMARAGYWYDQISGNKPNPPSAGKPDIEALANAVIRGEYGNGDQRRARLGGLYDAVQRRVNEKLAAGSAPAAPNIDALADAVIRGEYGNGATRRARLGNLYNQVQARVNQKLGC

SEQ ID NO: 527 - protein, 269 aa, Varibaculum cambriense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPVWGKNVFGHRDFSATECPASIAGSQHATYMARAGYWYDQMGGNKPNPPSAGKPDIEALANAVIRGEYGNGDQRRARLGSLYEAVQRRVNEKLGAKSAPAAPNIDALADAVIRGDYGNGATRRARLGNLYNQVQARVNQKLGC

SEQ ID NO: 528 - protein, 271 aa, Varibaculum cambriense
MKNWNTLEADIDLIMNTHYTPGRNGRRIDKVIIHHNAGNLTIRGCYDVWQTRPASTHYQVQTDGRIGQLVWDRDTAWHAGNFAANTTSIGIEHADVSSNPWAVSEACLDNGAHLVAAVCKFYGLGRPAWGKNVFGHKDFSATACPASLAGSQHAAYMSRAQSWYDQMSGSAPAPAPAAPNIDALADAVIRGDYGNGEERKRCLGANYAAVQQRVNEKLSGNAPAAKPAGPNIDALADAVIRGEYGNGEERKRRLGNLYSAVQARVNAKLGY

SEQ ID NO: 529 - protein, 270 aa, unidentified
  REGION 1..270: note = Actinotignum urinale
MKNWNTLEADIDLIMNKHYTPGRNGRRIDKVIIHHNAGNLTIRGCYDVWQTRPASAHYQVQSDGRIGQLVWDRDTAWHAGNWVANTTSIGIEHADMTSGSWAVSEACLDNGAHLVAAVCKYYKLGRPAWGKNVFGHKNFSSTECPASLAGSQHAAYMARAQSWYDQMTGNTPAPAPATPDIDALADAVIRGDYGNGEERKRRLGANYAAIQQRVNEKLSGRASAKPAGPNIDALADAVIRGEYGNGEERKRRLGNLYNAVQARVNAKLGY

SEQ ID NO: 530 - protein, 280 aa, unidentified; identical to SEQ ID NO: 124
  REGION 1..280: note = Cutibacterium granulosum

SEQ ID NO: 531 - protein, 318 aa, Eggerthella lenta
MNIVEFVQASGANYTAGRGGRAIDGMAVHYTATSASAHNNLVYFSRAGAGASAHLFVDKDGSIRQSVRLEDTAWAVGDFAENQRTVSVEAVSAGEGFTEAQVAALAEIWAFLRATYGVTRLIRHYDVTGKRCPAPYVDAGKWAALKERILGGSGAVVAPGPSGGAPSGSVADLAARVIAGEFGNGDARRAALGSRYDEVQAEVNRILLGGSGSAAPAAAAPAPAAPDIEALAQAVIRGEYGNGDARRAALGANYDAVQARVNEILGVGGGPSGGSGGADIEALAQAVIRGDYGNGEERRRRLGSLYDAVQARVNEILL

SEQ ID NO: 532 - protein, 303 aa, unidentified; identical to SEQ ID NO: 130
  source 1..303: note = Parolsenella sp.

SEQ ID NO: 533 - protein, 271 aa, Trueperella pyogenes
MKNWLALEADIDLIMNKHYTPGRNGRRIDKVIIHHNAGNLTIKGCYDVWQTRPASAHYQVQSDGRIGQLVWDRDTAWHAGNWVANTTSIGIEHADMTSDPWTVSEACLDNGAHLVAAICKFYGLGRPIWGKNVFGHKNFSSTECPASLAGSQHAAYMARAQSWYDQMTGNTPAPAPATPDIDALADAVIRGDYGNGEERKRRLGANYAAIQQRVNEKLSGNTPATKPAAPNIDALADAVIRGEYGNGEERKRRLGNLYSAVQARVNAKLGY

SEQ ID NO: 534 - protein, 316 aa, Slackia piriformis
MNIVEFIQASGANYTAGRGGHAIDGMAVHYTATSASAHNNLVYFSRPGAGASAHLFVDKDGAIRQSVRLEDTAWAVGDFAENQRTVSVEVVSAGEDFTDAQVAALAEIYAYLRATYGITRVIRHYDVTGKRCPAPYVDAGKWAALRARITGGGFGAAAGGGNGGSAPSGSVAELAQAVIRGDYGNGDARRGALGSRYDEVQAEVNRILGGGSASGGSSSGGSGADIKTLAQAVIRGDYGNGDARRAALGANYDAVQVRVNEILGAGGSSSGGSGGANIDALAQAVIRGDYGNGEARRRRLGSLYDAVQARVNEILL

SEQ ID NO: 535 - protein, 319 aa, Slackia piriformis
MAYSILFKQCGSDHMTRGRTRAIDRIVVHYTGTTASARNNATYFSRNENQGASAHYFVDDITPEIYQSVAEGDTAWHAGNWDMNCRSIGIEVVSAGEDFSEVEIAKLAWLVLKLMAKYGIGASGVIRHYDVTGKLCPAAYVDAGKWAALKARITGGGSGVAAGGGGGGAAPSGSVSELAQAVIRGDYGNGDARRAALGSRYDEVQAEVNRILGGGSVSGSSSGGSGVDIEALAQAVIRGDYGNGDARRAALGANYDAVQARVNEILGGGGSSSGGSGGADIEALAQAVIRGDYGNGEERRRRLGSLYDAVQARVNEILL

SEQ ID NO: 536 - protein, 313 aa, unidentified
  REGION 1..313: note = uncultured Collinsella sp.
MAYSILFKQCGGDHMTRGRSRAIDRIVVHFTATLASARNNATYFARNEGQGASAHYFVDDITPEIYQSVAEGDTAWHAGDWQMNCRAIGIEVVSAGEDFSDVEVDKLSWLVQRLMDKYGIGAAGVIRHYDVTGKRCPAPYVAASKWAALKAAITGGVVSGGTTPAAPDGTVAELARRVIAGEFGNGDARRAALGSRYSEVQAEVNRILAGGSSSAPAQPAAPDIEALAQAVIRGDYGNGDDRRAALGASYDAVQTRVNEILGAGGSDGGSGGADIDALARAVIRGEYGNGEERRSRLGPLYDAVQARVNEILL

SEQ ID NO: 537 - protein, 133 aa, Corynebacterium striatum
  SITE 43: note = misc_feature - Xaa can be any naturally occurring amino acid
  SITE 53: note = misc_feature - Xaa can be any naturally occurring amino acid
MADPPSIRPLDNGAHLVAAICHYYKLGRPVWGKNVFGHKHFSXTECPASLAGXQHAAYMARAQYWYDRMSGTKPAPTAPAKPTPPAPKPSVNIDALADAVIRGDYGNVEERKRRLGANYAAVQKRVNEKLGIG

SEQ ID NO: 538 - protein, 169 aa, Collinsella tanakaei
MGGGGAAVAPGPSGGAPSGSVADLAARVIAGEFGNGDARRAALGSRYDEVQAEVNRILLGGSGSAAPAAAAPAPAAPDIEALAQAVIRGEYGNGDARRAALGANYDAVQARVNEILGVGGGSSGGSGGADIEALAQAVIRGDYGNGEERRRRLGSLYDAVQARVNEILL

SEQ ID NO: 539 - protein, 231 aa, Actinomyces urogenitalis
MDAILSARPFRESHAVLESTKPSTDPIDKIVLHHNAGTLSIRGCYDVWQTREASAHYQVDVNGRIGQLVWDRDTAWHAGNLAANRTSIGIEHANATSTTSPITEATLDAGAHLVAAICIRYRLGRPAWGVNVFGHKHFSATACPGHIAGDQNSAYMARAQHWYDQMTGTATPTPPPPAPAPAPDLDALADAVIRGEYGNGDERRHRLGNLYDQVQRPPRTIKRPHATPAVV

SEQ ID NO: 540 - protein, 115 aa, Arcanobacterium pluranimalium
MISYIDAYKEQFGVEAICRVFSRTDRGEYGNGDERKRRLGANYAAVQARVNQKLGATPRTPAPAPAVNIDALADAVIRGEYGNGEARQVLVAVLDKTQAVTGALLLRVRLDKHRV

SEQ ID NO: 541 - protein, 259 aa, unidentified
  REGION 1..259: note = Boudabousia tangfeifanii
MEILMSYTIDHSHDATAFTTGRQGHRIKYIVVHHWDDPAKHPTFEGTIRWFERGGNNTSAHYVAEAGRVAQLVADGNTAYHAGNWVKNLESIGIECNPRCSDADKATVAELIRDLQAKHGPLTILGHKDCSSTDCPGRYYPPTTVLAPWLGGGGGNGRSASGVDSPSGDLNALADAVLRGDYGNGDERKRRLGSKYSAVQAIVNQRLGYGSTPVSSGPDLNALADAVIRGEYGNGDERRRRLGANYKAVQALVNKKLGY

SEQ ID NO: 542 - protein, 316 aa, unidentified
  REGION 1..316: note = Caudoviricetes sp.
MNVVEFIQASSANYTAGRGGNAIDGMAVHYTATSASAHDNLVYFSRPGAGASAHLFVDKDGSMRQSVRFEDTAWAVGNWVENQRTVSAEVVSAGEDFTDAQVAALAEIYAYLRATYGISRVIRHYDVTGKRCPAPYVDENKWASLKARILGGSGASASGGSGGGAPSGSVADIAQRVIAGEFGNGDARRAALGSRYDEVQAEVNRILLGGGSQGSSGGNAASADIEALAQAVIRGDYGNGDARRAALGSNYDAVQARVNKILLGGSSGGSGSSGRADIEALAQAVIRGEYGNGEERKRRLGSLYAAVQARVNEILL

SEQ ID NO: 543 - protein, 263 aa, unidentified
  REGION 1..263: note = Caudoviricetes sp.
MGHSILFKQCGSDHMTRGRSRLIDRIVVHYTSTLASARNNAIYFSRNERQGSSAHYFADDITDEIYQRVDDADAAWHAGNWDMNCRSIGIEVVSAGEDYSEAEVGKLAWLVGELMRKYGIGASGVIRHYDVTGKICPAPYIEAGRWAALKARICGCELPAGGGSAAAPSGDVGDLARRVIAGEFGNGEERKRRLGASYAAVQARVNEILGGGNSGSAGGSGGVDVDALARAVIRGDYGNGEERKRRLGSNYAVVQRRVNEMLS

SEQ ID NO: 544 - protein, 343 aa, unidentified
  REGION 1..343: note = Caudoviricetes sp.
MQMTMKGIDIADWQKNLNLDSIEYDFVIIKGTQGTNYVNTFCDAFVQKAIKAGKLWGFYHFMNMDDPIKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYNAPAATAYENSGSTADLAADVMRGKYGNGDERKAKLGARFNEVQDLINRTATASADDLAADVLNGKLGNGETRKVILGTRYDEVQAVVNSRVNAVDIDALARAVIRGEYGNGDERKARLGANFDAVQKRVNELL

SEQ ID NO: 545 - protein, 211 aa, unidentified
  REGION 1..211: note = Bacteriophage sp.
MSFDFITQYDSPNYTVGRPYGVACIVIHWWGDPAEHPTFEGVISTLCSPSRGASANYVGEAGRVACLVDPDNRSWASGDGINVNSMGNDRGISIECNPRQSDGDYATIGELIANIRSVYGDLPLYRHRDFSATECPGTYDLARLDAIARGAAVSQPSAPAAPAAPSAPSVDIDALANAVIRGDYGVGEERRARLGVNYDAVQNRVNEILLG

SEQ ID NO: 546 - protein, 303 aa, unidentified
  REGION 1..303: note = Caudoviricetes sp.
MNIAEFIQCHASNFTKGRGGNAIDGMAVHYTATSASAHNNLVYFSRAGANASAHLFVDKDGTIRQSVHFEDTAWAVGNFPQNQRTVSVEVVSAGEDFTDAQINALAQIYEYLRATYGITRVIRHYDVTGKRCPAPYVDESKWAALKARITGGSSSSAPSGGSAPSGSATDLAKRVIAGEFGNGDARKAALGSRYDEVQAEVNRILNGGGSSSPSVDIDQMARDVIAGKYGNGDARKAALGSNYDAVQARVNELLGADGGSSGGADIDALARAVIRGDYGNGEERKRRLGSLYDAVQARVNQLL

SEQ ID NO: 547 - protein, 340 aa, unidentified; identical to SEQ ID NO: 127
  REGION 1..340: note = Caudoviricetes sp.

SEQ ID NO: 548 - protein, 343 aa, unidentified
  REGION 1..343: note = Caudoviricetes sp.
MTMKGIDISNYQRGLDLGAIDYDFVFCKATEGTGIVHDTCDPFIQKAISMGKCWGFYHFLNKEDPIAQANHFYENCKNYFGVGVPMLDYEDYGRIGTDKAKQFLDRIYELTGVRCIVYISRSVCTEEDWSAIAPNHALWVAQYADNNETGYQDSPWLASGAFGAWDSCAIHQYTSHGRINGYDGLLDLDIAYMDAAAWAKFANPNGGTPAPAPSSNDPQGSTADIAAAVMRGEYGNGGDRRNRLGSRYDDVQNLINRAASASVDDLASDVLNGVFGNGDTRRAILADRYDDVQARVNERANGVDIDALARAVIRGEYGDGDARRSALGSNYDAVQKRVNELLV

SEQ ID NO: 549 - protein, 198 aa, unidentified
  REGION 1..198: note = Caudoviricetes sp.
MCLGGGKIGHFTGSETGGIDGAPGDQTGRESRIQDYYRGNWDGVLHYNGKADSGGAPGGSGSGAPSGDVSELARRVIAGEFGNGDARRAALGSRYDEVQAEVNRILGGGSVDVDALARRVIAGEFGNGDERRRRLGSNYDAVQQRVNEILLGSNSSSIDVDAMARAVIRGDYGNGEERRRRLGSYYSIVQARVNEMLS

SEQ ID NO: 550 - protein, 339 aa, unidentified
  REGION 1..339: note = Bacteriophage sp.
MKGIDIADWQKNLNLDSIEYDFVIIKGTQGTNYVNTFCDAFVQKAIKAGKLWGFYHFMNMDDPVKQADHFYQNCKNYFGKGVPVLDYEDGGRIGTDGAKKFLDRIYALTGVRCLLYTYRNLTKEEDWSKIAPNHALWVAQYANENQTGYQDSPWLPDGGFGAWNTCVMHQYSSYGRLSGYNGNLDLDIAFMDAAAWSRYAKPSTYNAPVETAHENSGSTADLAAGVMLGKYGNGDERKAKLGTRFNEVQTLVNRAATASADDLATDVLNGKLGNGETRKVILGNRYDEVQAVVNSRVNAVDIDALAHAVIRGEYGNGDERKARLGANFDAVQKRVNELL

SEQ ID NO: 551 - protein, 187 aa, unidentified
  REGION 1..187: note = Candidatus Olsenella pullicola
WAALKASITGGAASGGTTSAAPGGTVAELARRVIAGEFGNGDARRAALGSRYPEVQAEVNRILAGGSGGGAAQAPAADDVDDLARRVIAGEFGNGAARKAALGSRYAEVQARVNEMLGAGGSGGPSGGADVDALAHAVIRGDYGNGADVDALAHAVIRGDYGNGAERKRRLGSLYDAVQARVNEILS

SEQ ID NO: 552 - protein, 189 aa, unidentified
  REGION 1..189: note = Candidatus Olsenella pullicola
MLNRQNTGKLCPAPYVAPSKWAALKAAITGGVVSGGTTPAAPGGTVAELARRVIAGEFGNGDARRAALGSRYPEVQAEVNRILAGGSGGGAAQAPASDDVDDLARRVIAGEFGNGEARKAALGDRYAEVQARVNEMLGAGGSGGSSGGADVDALARAVIRGDYGNGAERKRRLGSLYDAVQARVNEILS

SEQ ID NO: 553 - protein, 318 aa, unidentified
  REGION 1..318: note = Rubneribacter badeniensis
MNIVEFVQASGANYTAGRGGRAIDGMAVHYTATSASAHNNLVYFSRAGAGASAHLFVDKDGSIRQSVRLEDTAWAVGDFAENQRTVSVEVVSAGEGFTDSQVAALAEIWAFLRATYGVTRLIRHYDVTGKLCPAPYVDAGKWAALKARILGGSGAAVAPGPSGGAPSGSVADLAARVIAGEFGNGDARRAALGSRYDEVQAEVNRILLGGSGSAAPAAAAPAPAAPDIEALAQAVIRGEYGNGDARRAALGANYDAVQARVNEILGVGGGSSGGSGGADIEALAQAVIRGDYGNGEERRRRLGSLYDAVQARANEILL

SEQ ID NO: 554 - protein, 54 aa, unidentified
  REGION 1..54: note = Enorma phocaeensis
MLGAGGSGGSSGGADIDALAHAVIRGDYGNGAERKRRLGSLYGAVQARVNEMLS

SEQ ID NO: 555 - protein, 286 aa, Olsenella sp.
MADVCEFIQCDRRNYTPGRGGQRVRRVVVHYTGAKGNAHENLVYFSRNRCGASAHYFIGKGGDVRQSVRESDTAWHAGNWGMNLMSVGIEVCSAGEDFTEAQVASLASLVGDLMRRYGIPASGVIRHYDVTGKRCPAPYVDAGKWARLHARITGGGATTAPAKAAPAGGSGGGASGGGFLVRVTADALNVRSGPGAHFPKAGCIRDRGTYTIVEARDCWGRLKSGAGWICLNYTTRAGNSGPSPTVNVDALARAVIRGEYGTGAERRRRLGMSYEAVQRRVNEILR

SEQ ID NO: 556 - protein, 258 aa, unidentified
  REGION 1..258: note = Atopobiaceae bacterium
MNRHFTRGRGGARIQHIVVHYNDADGSVEDVWNWWQTRKASAHYQVESSGRVGQLVWDRDTAWHAGLWSENLRSIGIEHANRRDGTISEACLDNGAHLVAALCRLYGLGRPQWNVNVFPHCHFASTSCPGQIYGSQKDAYISRAQLWYDRMGAGGAASASPAPTAPSSDIDSLAREVIAGKYGNGDDRRRALGANYDRVQARVNEILGTGSKPRTRAVDVDALARAVIRGDYGNGEERKRRLGANYAAVQRRVNELLS

SEQ ID NO: 557 - protein, 272 aa, Olsenella sp.
MRDWARCEADVVRLMNKHFTPGRSGARIQHVVVHYNDADGSVEDVWGWWQTRKASAHYQVESSGRVGQLVWDRDTAWHAGLWSENLRSIGIEHANRSDGTISEACLDNGAHLVAALCRLYGLGRPQWNANVFPHCHFASTSCPGQIYGSQRDAYISCAQLWYDRMGAGGAASASPAPTVSSLDIDALAREVIAGKYGNGDDRRRALGANYDRVQARVNEILGIGSKPRVQAVDVDALARAVIRGDYGNGEERKRRLGANYTAVQRRVNELLS

SEQ ID NO: 558 - protein, 339 aa, Collinsella sp.
MKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSRIAPNHALWVAQYANENQTGYQDSPWLPDGGFGAWNTCVMHQYSSHGRLSGYNGNLDLDIAFMDAAAWSRYAKPSTYNAPAATDNENCGSTVDLAAGVMRGEYGNGDERKAKLGARFNEVQDLINRTATASADDLATDVLNGKLGNGETRKVILGIRYDEVQAVVNSRVNAVDIDALARAVIRGEYGNGDERKARLGANFDAVQKRVNELL

SEQ ID NO: 559 - protein, 40 aa, Actinomyces sp.
IDALADAVIRGDYGNGEERKRRLGNLYAAVQARVNAKLGY

SEQ ID NO: 560 - protein, 341 aa, Slackia isoflavoniconvertens
MTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYSAPDATDNKNNGSTVDLAAGVMRGEYGNGDERKAKLGARFNEVQDLINRAATASAGDLATDVLNGKLGNGETRKAILGIRYDEVQAVVNSRAKAVDIDALARAVIRGEYGNGDERKARLGSNFNAVQKRVNELL

SEQ ID NO: 561 - protein, 332 aa, unidentified
  REGION 1..332: note = Microbacterium phage ChickenKing
MAKFSSLISGTTPDHGKNRGKDEKKTRLIVHHWAGTAGGDTALMKPKGQNSRGDVSASYILYSDGRLIGQVSEDLSPWTTGQADWGSITVETQNAANGGIWPIDQRAKDKLAQLMADLSDRHGWGELKLGTNVRMHREFNATACPGPDMVNSLPAIIAKANQLRKGGSGSSGGGQPASGGTYTVSKGESLSSIASKYGTTWQVLQSLNNLSNPNKIYPGQKLVVPSAPSGGGSKPSQSLSDVAKAVLRGDYGNGATRVAKLRAAGYDPNEVQAEVNRQLYGNPKSSSGGVDIDGLARAVIRGDYGNGSERQRRLGSNYSAVQKRVNEILAGK

SEQ ID NO: 562 - protein, 332 aa, unidentified
  REGION 1..332: note = Microbacterium phage GaeCeo
MAKFSSLISGTTPDHGKNRGKDEKKTRLIVHHWAGTAGGDTALMKPKGQNSRGDVSASYILYSDGRLIGQVSEDLSPWTTGQADWGSITVETQNAANGGIWPIDQRAKDKLAQLMADLSDRHGWGELKLGTNVRMHREFNATACPGPDMVNSLPAIIAKANQLRKGGSGSSGGGQPASGGTYTVSKGESLSSIASKYGTTWQVLQSLNKLPNPNKIYPGQKLVVPSAPSGGGSKPTQSLSDVAKAVLRGDYGNGATRVAKLRAAGYDPNEVQAEVNRQLYGNPKSSSGGVDIDGLARAVIRGDYGNGSERQRRLGSNYSAVQKRVNEILAGK

SEQ ID NO: 563 - protein, 343 aa, unidentified
  REGION 1..343: note = Collinsella sp. AM31-2AC
MQMTMKGIDIADWQKNLNLDSIEYDFVIIKGTQGTNCVNTFCDAFVQKAIKAGKLWGFYHFMNMDDPVKQADHFYQNCKNYFGKGVPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYNAPVETAHENSGSTADLAAGVMRGKYGNGGERKAKLGTRFNEVQTLVNRAATASADDLATDVLNGKLGNGETRKVILGTRYDEVQAVVNSRVNAVDIDALARAVIRGEYGNGDERKARLGANFDAVQKRVNELL

SEQ ID NO: 564 - protein, 272 aa, unidentified
  REGION 1..272: note = Coriobacteriaceae bacterium
MRDWARCEADVVRLMNRHFTRGRGGARIQHIVVHYNDADGSVEDVWNWWQTRKASAHYQVESSGRVGQLVWDRDTAWHAGLWSENLRSIGIEHANRRDGTISEACLDNGAHLVAALCRLYGLGRPQWNVNVFPHCHFASTSCPGQIYGSQKDAYISRAQLWYDRMGAGGAASASPAPTAPSSDIDSLAREVIAGKYGNGDDRRRALGANYDRVQARVNEILGTGSKPRTRAVDVDALARAVIRGDYGNGEERKRRLGANYAAVQRRVNELLS

SEQ ID NO: 565 - protein, 333 aa, unidentified
  REGION 1..333: note = Microbacterium phage Cheeto1
MAKFSSLISGTTPDHGKNRGKDEKKTRLIVHHWAGTAGGDTALMKPKGQNSRGDVSASYILYSDGRLIGQVSEDLSPWTTGRADWGSITVETQNAANGGNWPIDQRAKDKLAQLMADLSDRHGWGELKLGTNVRMHREFNATACPGPDMVASLPAIIAKANKLRKGGSGGSSGGGQPASGGTYTVSRGESLSSIASKYGTTWQELQRLNKLSDPNKIYPGQKLVVPSAPSGGGSKPSQSLSDVAKAVLRGDYGNGSTRVAKLRAAGYDPNEVQAEVNRQLYGNPKSSSGGVDIDGLARAVIRGDYGNGAERQRRLGSNYSAVQKRVNEILAGK

SEQ ID NO: 566 - protein, 343 aa, unidentified
  REGION 1..343: note = Bacteriophage sp.
MQMTMKGIDIADWQKNLNLDSIEYDFVIIKGTQGTNYVNTFCDAFVQKAIKAGKLWGFYHFMNMDDPIKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSNGRLSGYNGNLDLDIAFIDAAAWSRYAKPSTYNAPAATAYENSGSTADLAADVMRGKYGNGDERKAKLGARFNEVQDLINRTATASADDLAADVLNGKLGNGETRKVILGTRYDEVQAVVNSRVNAVDIDALARAVIRGEYGNGDERKARLGANFDAVQKRVNELL

SEQ ID NO: 567 - protein, 343 aa, unidentified
  REGION 1..343: note = Bacteriophage sp.
MQMTMKGIDIADWQKNLNLDSIEYDFVIIKGTQGTNYVNTFCDAFVQKAIKAGKLWGFYHFMNMDDPIKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFIDAAAWSRYAKPSTYNAPAATAYENSGSTADLAADVMRGKYGNGDERKAKLGARFNEVQDLINRTATASADDLAADVLNGKLGNGETRKVILGTRYDEVQAVVNSRVNAVDIDALARAVIRGEYGNGDERKARLGANFDAVQKRVNELL

SEQ ID NO: 568 - protein, 343 aa, unidentified
  REGION 1..343: note = Bacteriophage sp.
MQMTMKGIDIADWQKNLNLDSIEYDFVIIKGTQGTNYVNTFCDAFVQKAIKAGKLWGFYHFMNMDDPIKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFIDAAAWSRYAKPSTYNAPAATAYEYSGSTADLAADVMRGKYGNGDERKAKLGARFNEVQDLINRTATASADDLAADVLNGKLGNGETRKVILGTRYDEVQAVVNSRVNAVDIDALARAVIRGEYGNGDERKARLGANFDAVQKRVNELL

SEQ ID NO: 569 - protein, 322 aa, unidentified
  REGION 1..322: note = Bacteriophage sp.
MSNSPLVNYTRISPNRNSPRNQPISKITVHHMAGNLSVETCGNVFAPSSRQASSNYGIGSDGRVGMYVEEKDRSWASSSAWNDHRAVTIEVANDQIGGNWHVSDAAWNKLVELCVDICRRNGMKSLVWTGGTDGSLTCHYMYASTNCPGPYLKGRMAELARTVTARLGGASGPSTSGGSSAPSGSVADLANRVIAGEFGNGDARKAALGDRYAEVQAEVNRILNGGGSTSSPSVDIDQMARDVIAGKYGNGDARKKALGSNYAAVQARVNELLGASGGSFGGADIDALARAVIRGDYGNGEERKRRLGSLYDAVQARVNQLL

SEQ ID NO: 570 - protein, 269 aa, Bifidobacterium dentium; identical to SEQ ID NO: 133

SEQ ID NO: 571 - protein, 271 aa, Varibaculum cambriense
MKNWNTLEADLNLLMNKHFTKGRHGRSINKIILHHNDGNLSIQGCWNVWQTRPASAHYQVETSGRIGQLVWDRDTAWHAGNWVANTTSIGIEHADASTHPYRISDACLENGAHLLAALCHYYKLGRPVWGKNVFGHRDFSATECPASIAGSQHATYMARACYWYDQISGNKPQASSAGKPDIEALANAVIRGEYGNGDQRRARLGGLYEAVQRRVNEKLGFKAKPAGKSIETLAREVIRGDWGNGQERYNRLTNAGYNYQQVQNRVNQILA

SEQ ID NO: 572 - protein, 255 aa, unidentified
  REGION 1..255: note = Boudabousia liubingyangii
MSYTIDHSHDATAFTTGRQGHRIKYIVVHHWDDPAKHPTFEGTIRWFERGGNNTSAHYVAEAGRVAQLVADGDTAYHAGNWVKNLESIGIECNPRCSDADKATVAELIRDLQAKHGPLTILGHKDCTSTDCPGRYYPPTRVLAPWLSGGSGNAKPATTATAPSGDLNALADAVLRGDYGNGEERKRRLGSKYSAVQAIVNQRLGYGTAPASTGPDLNALADAVIRGDYGNGDERRRRLGSNYAAVQALVNRKLGY

SEQ ID NO: 573 - protein, 314 aa, unidentified
  REGION 1..314: note = unclassified Olsenella
MAYSILFKQCGSDHMTRGRSRAIDRIVVHFTATLASARNNATYFARNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVAASKWAALKARITGGGSSGGTTAVAPEGTVAELARRVIAGEFGNGDARRAALGSRYPEVQAEVNRILAGGSGGGAAQSPAADDVDDLARRVIAGEFGNGAARKAALGDRYAEVQARVNEMLGAGGSGGSSGGADVDALARAVIRGDYGNGTERKRRLGSLYDAVQARVNEILS

SEQ ID NO: 574 - protein, 322 aa, unidentified
  REGION 1..322: note = Olsenella sp. An188
MSNSPLVNYTRISPNRNSPRNQPISKITVHHMAGNLSVETCGNVFAPSSRQASSNYGIGSDGRVGMYVEEKDRSWASSSAWNDHRAVTIEVANDQIGGNWHVSDAAWNKLVELCVDICRRNGMKSLVWTGGTDGSLTCHYMYASTNCPGPYLKGRMAELARTVTARLGGASGPSTSGGSSAPSGSVADLANRVIAGEFGNGDARKAALGDRYAEVQAEVNRILNGGGSTSSPSVDIDQMARDVIAGKYGNGDARKKALGSNYAAVQARVNELLGASGGSSGGADIDALARAVIRGDYGNGEERKRRLGSLYDAVQARVNQLL

SEQ ID NO: 575 - protein, 339 aa, unidentified
  REGION 1..339: note = Collinsella
MKGIDIADWQKNLNLDSIEYDFVIIKGTQGTNCVNTFCDAFVQKAIKAGKLWGFYHFMNMDDPVKQADHFYQNCKNYFGKGVPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYNAPVETAHENSGSTADLAAGVMRGKYGNGGERKAKLGTRFNEVQTLVNRAATASADDLATDVLNGKLGNGETRKVILGTRYDEVQAVVNSRVNAVDIDALARAVIRGEYGNGDERKARLGANFDAVQKRVNELL

SEQ ID NO: 576 - protein, 314 aa, unidentified
  REGION 1..314: note = Olsenella sp. An293
MAYSILFKQCGSDHMTRGRSRAVDRIVVHFTATLASARNNATYFARNEGQGASAHYFVDDITPEIYQSVAEGDTAWHAGDWQMNCRAIGIEVVSAGEDFSATEVEKLGWLVRRLMAKYGIGASGVIRHYDVTGKLCPAPYVAASKWAALKARITGGVVSGGTTPAAPSGTVAELARRVIAGEFGNGDARRAALGSRYSEVQAEVNRILAGGSGGDASQAPAADDVDDLARRVIAGEFGNGAARKAALGDRYAEVQSRVNEMLGAGGSGGSSGSADVDALARAVIRGDYGNGAERKRRLGSLYDAVQARVNEILS

SEQ ID NO: 577 - protein, 315 aa, unidentified
  REGION 1..315: note = Enorma phocaeensis
MAYSILFKQCGSDHMTRGRSHAVDRIVVHFTATLASARNNATYFSRNEGQGSSAHYFVDDITPEIYQSVAEGDTAWHAGNWLMNCRAVGIEVVSAGEDFSATEIAKLSWLVKKLMAKYGIGASGVIRHYDVTGKLCPAPYVSASKWAALKAAITGGAAAPSGSVEPAPSGTVAELARRVIAGEFGNGDARRAALGSRYSEVQAEVNRILAGGSGGPAAQAPASDDVDDLARRVIAGEFGNGTARKAALGSHYAEVQARVNEMLGAGGSGGSSGGADIDALAHAVIRGDYGNGAERKRRLGSLYGAVQARVNEMLS

SEQ ID NO: 578 - protein, 315 aa, unidentified
  REGION 1..315: note = Olsenella sp. SW781
MAYSILFKQCGSDHMTRGRSRAIDRIVVHYTGTTASARNNATYFARNEGQGASAHYFVDDITPEIYQSVAEGDTAWHAGNWDMNCRAIGIEVVSAGEDYSGTEITKLAWLVQKLMAKYGIGSSGVIRHYDVTGKLCPAPYVASSKWAALKARITSGVVSGGTTPAAPEGAVAELARRVIAGEFGNGDARRAALGSRYSEVQAEVNRILAGGSGAPAAQAPAADDVDDLARRVIAGEFGNGAARKAALGDRYAEVQARVNKMLGAGGSSGGSSGGADVDALARAVIRGDYGNGAERKRRLGSHYDAVQARVNEMLS

SEQ ID NO: 579 - protein, 254 aa, unidentified
  REGION 1..254: note = Canibacter zhuwentaonis
MSYTIDHSHDATAFTHGRQGHRIKYIVVHHWDDPAKHPTFEGTIRWFERGGNNTSAHYVVETGRVAQLVADSNTAYHAGNWVKNLESIGIECNPRCNEADKATVAELIRDLQTKHGPLTILGHKDCTSTDCPGRYYPPTSVLAPWLGGGGNAKPAATASTPSGELNTLADAVLRGDYGNGEERKRRLGSKYSAVQAIVNQRLGYGSATTSAGPDLNALADAVIRGDYGNGDERRRRLGANYAAVQRIVNRKLGY

SEQ ID NO: 580 - protein, 316 aa, Collinsella tanakaei
MAYSILFKQCGSDHMTRGRSRAIDRIVVHFTATLASARNNATYFARNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVDAGRWAVLRAAITGGSSSAAVSGGSGGTPSGTTAELAQAVIRGEYGNGDARRDALGSRYGEVQEEVNRILAGGGSVSAPQASGDSVDDLARRVIAGEFGNGKARRAALGDRYAEVQARVNEMLGAGGSGEQSGGADVEALAQAVIRGEYGNGEERKRRLGSLYDAVQARVNEILL

SEQ ID NO: 581 - protein, 146 aa, unidentified; identical to SEQ ID NO: 125
  REGION 1..146: note = Tractidigestivibacter scatoligenes

SEQ ID NO: 582 - protein, 255 aa, unidentified; identical to SEQ ID NO: 126
  REGION 1..255: note = Boudabousia tangfeifanii

SEQ ID NO: 583 - protein, 314 aa, unidentified; identical to SEQ ID NO: 128
  REGION 1..314: note = Thermophilibacter provencensis

SEQ ID NO: 584 - protein, 316 aa, unidentified
  REGION 1..316: note = uncultured Enorma sp.
MAYSILFKQCGSDHMTRGRSHAIDRIVVHFTATLASARNNATYFSRNEGQGASAHYFVDDISPEIYQSVAEGDTAWHAGNWLMNCRAVGIEVVSAGEDFSATEIQKLAWLVRKLMAKYGIGASGIIRHYDVTGKLCPAPYVDAGKWAVLRAAITGGSSSAAVSGGSGGTPSGTTAELAQAVIRGEYGNGDARRDALGSRYGEVQAEVNRILAGGGSVSAPQASGDSVDDLARRVIAGEFGNGKARRAALGDRYAEVQARVNEMLGAGGSGEQSGGADVEALAQAVIRGEYGNGEERKRRLGSLYDAVQARVNEILL

SEQ ID NO: 585 - protein, 269 aa, Varibaculum sp.
MKNWNTLEADLNLLMNKHFTTGRQGRSINKIILHHNDGNLSIQGCWNVWQTRPASAHYQVETSGRIGQLVWDRDTAWHAGNWVANTTSIGIEHADASTHPYRISDDCLENGAHLVAALCHYYKLGRPVWGKNVFGHRDFSATECPASIAGSQHAAYMARAGYWYDQMSGNKPQASSAGKPDIEALANAVIRGEYGNGDQRRTRLGSLYEVVQRRVNEKLGARSTPAAPNIDALADAVIRGEYGNGATRRARLGNLYNQVQARVNQKLGC

SEQ ID NO: 586 - protein, 269 aa, Varibaculum sp.
MKNWNTLEADLNLLMNKHFTTGRQGRSINKIILHHNDGNLSIQGCWNVWQTRPASAHYQVETSGRIGQLVWDRDTAWHAGNWVANTTSIGIEHADASTHPYRISDDCLENGAHLVAALCHYYKLGRPVWGKNVFGHRDFSATECPASIAGSQHAAYMARAGYWYDQMSGNKPQASSAGKPDIEALANAVIRGEYGNGYQRRTRLGSLYEVVQRRVNEKLGARSTPAAPNIDALADAVIRGEYGNGATRRARLGNLYNQVQARVNQKLGC

SEQ ID NO: 587 - protein, 346 aa, unidentified
  REGION 1..346: note = uncultured Senegalimassilia sp.
MSMRGFDISDWQKGIDIDSVDYDFVICKATQGTSYVNGYCDINIQKAKQAGKPWGFYHFMWDCDPVEQADYFYANCKNYFGEGIPILDYEDGGRIGSDGAKKFLDRIYELTGIRCLFYTYRNIVQSPHDDEDWCTIAQNHGLWVAQYANDAPTGYQDSPWLPGGGFGAWETCVIHQYTSHGRIDGYGGNLDLDIAFMTADAWERYTKPGTCNTQPAASDAPNGTAADIAADVMRGKYGNGEERKAKLGARFDEVQNLINRSATESADNLASDVLNGLFGNGETRRAILGNRYDEVQTVVNRKANAVDIDALARAVIRGEYGDGDARRSALGSNYDAVQKRVNELLV

SEQ ID NO: 588 - protein, 229 aa, Trueperella abortisuis
MKNWNTLEADIDLIMNKHHTAGRSGRKIDKVIIHHNAGNLTIKGCWDVWQTRQASAHYQVQSDGTIGQLVWDSDTACHARNWDANTTSIGIEHADVSSSPWKVSEACLDNGAHLVAAVCRYYKLGRPQWGKNVFGHKNFSATECPASLAGSQHAAYMKRAQYWYDHMTGSKPAPAKPSHAKPAPSTPPNIDALADAVIRGEYGNGEERKRRLGGLYAQVQKRVNQKLGY

SEQ ID NO: 589 - protein, 310 aa, unidentified
  REGION 1..310: note = Thermophilibacter mediterraneus
MNVVEFIQANPANYTAGRGGRAIDGMAVHYTATSASAHNNLVYFSRPGAQASAHLFVDKDGSIRQSVRFEDTAWAVGNFAENQRTVSVEVVSAGEDFTEAQIAALAEIYQYLRATYGITRVIRHYDVTGKRCPAPYVDADKWAALRARITGGGAAAAPSGGGSAPSGSVEDLARRVIAGEFGNGDARRAALGSRYDEVQARVNEILLGGPAAPGQPAAPDIEALARAVIRGDYGNGDARRAALGASYDAVRARVNEILGVGGASSGAGGADIEALAQAVIRGEYGNGEERKRRLGANYAAVQARVNEILL

SEQ ID NO: 590 - protein, 342 aa, unidentified
  REGION 1..342: note = Collinsella sp. CLA-ER-H5
MTMKGIDISDYQRGLDLGAIDYDFVFCKATEGTGIVHDTCDPFIQKAISMGKCWGFYHFLNKEDPIAQANHFYENCKNYFGVGVPMLDYEDYGRIGTDKAKQFLDRIYELTGVRCIVYISRSVCTEEDWSAIAPNHALWVAQYADNNETGYQDSPWLASGAFGAWDSCAIHQYTSHGRINGYDGLLDLDIAYMDAAAWAKFANPNGGTPAPAPSNDPQGSTADIAAAVMRGEYGNGGDRRNRLGSRYDDVQNLINRAASASVDDLASDVLNGVFGNGDTRRAILADRYDDVQARVNERANGVDIDALARAVIRGEYGDGDARRSALGSNYDAVQKRVNELLV

SEQ ID NO: 591 - protein, 312 aa, Trueperella pyogenes
MGYSYSFDPASPANYTVGRGGKRITTIVIHHWDDPAKNPQLGGVVTTFKNPGRGASAHYVVEAGRVVQMVDLANTAWHAGNWPVNQCSIGIECNPRCSEADKATIGELIRDLQAKYGPLRIIGHKDASSTACPGRYYPPASVLAPYIGGGGSVPAPTPAVSGDVDELAHRVIAGEFGNGEERKTRLGSQYGAVQARVNEILAGRPAQPNPAAPATPAPAADIEALADAVIRGEYGNGNDRKARLGHLYDAVQARVNAKLGQAPTAAPAPGPNLEAMADAVIRGEYGNGAERRNRLGHLYDAVQAIVNRKLGY

SEQ ID NO: 592 - protein, 315 aa, Collinsella tanakaei
MAYSILFKQCGSDHMTRGRSRAIDRIVVHFTATLASARNNATYFARNEGQGASAHYFVDDITPEIYQSVAEGDTAWHAGDWQMNCRAIGIEVVSAGEDFSATEVEKLGWLVKRLMARYGIGASGVIRHYDVTGKLCPAPYVAASKWAALKAAITGGGSSGGTTSAAPGGTVAELARRVIAGEFGNGDARRAALGSRYDEVQAEVNRILAGGGSGGGAAQAPAADSVDDLARRVIAGEFGNGAARKAALGSRYAEVQARVNEMLGVGGSGGSSGGADIEALAQAVIRGEYGNGEERRARLGALYDAVQARVNEILL

SEQ ID NO: 593 - protein, 58 aa, Varibaculum cambriense
MNEKLSGNASAPKPAGPNIDALADAVIRGDYGNGEERKRRLGNLYSAVQARVNAKLGY

SEQ ID NO: 594 - protein, 33 aa, Actinomyces urogenitalis
AVIRGEYGNGDERRHRLGNLYDQVQQRVNAKLS

SEQ ID NO: 595 - protein, 204 aa, unidentified
  REGION 1..204: note = Bifidobacterium
MRKKFVAAVAAFAALCGMVSVPANAAETTQPIREDVTPHVLVPIPVPESKLVSEPEPVDIDALAAAVIRGEYGDGEARRAALGDNYDAVQARVNELVPVAAPVVSQPVQAAPVVSQSVQSAPAQSVPQAAPRSYTFEDVYNLAVNSPYCELEDGSDLPQCYWHDGAGDGSEPPYTDIVYMPDGYGYQAHEDTMTVSVFARNPWL

SEQ ID NO: 596 - protein, 204 aa, unidentified
  REGION 1..204: note = Bifidobacterium
MRKKFVAAVAAFAALCGMVSVPANAAETTQPIREDVTPHVLVPIPVPESKLVSEPEPVDIDALAAAVIRGEYGDGEARRAALGDNYDAVQARVNELVPVAAPVVSQPVQAAPVVSQSVQSAPAQSVPQAAPRSYTFEDVYNLAVNSPYCELEDGSDLPQCYWHDGAGDGSEPPYTDIVYMPDGYGYQAHEDTMTVSVFVRNPWM

SEQ ID NO: 597 - protein, 204 aa, unidentified
  REGION 1..204: note = Bifidobacterium
MRKKFVAAVAAFAALCGMVSVPANAAETTQPIREDVTPHVLVPIPVPESKLVSEPEPVDIDALAAAVIRGEYGDGEARRAALGDNYDAVQARVNELVPVAAPVVSQPVQAAPVVSQSVQSAPAQSVSQAAPRSYTFEDVYNLAVNSPYCELEDGSDLPQCYWHDGAGDGSEPPYTDIVYMPDGYGYQAHEDTMTVSVFVRNPWM

SEQ ID NO: 598 - protein, 210 aa, Bifidobacterium breve
MEVRTIMRKKFVAAVAAFAALCGMVSVPANAAETTQPIREDVTPHVLVPIPVPESKLVSEPEPVDIDALAAAVIRGEYGDGEARRAALGDNYDAVQARVNELVPVAAPVVSQPVQAAPVVSQSVQSAPAQSVPQAAPRSYTFEDVYNLAVNSPYCELEDGSDLPQCYWHDGAGDGSEPPYTDIVYMPDGYGYQAHEDTMTVSVFARNPWL

SEQ ID NO: 599 - protein, 210 aa, Bifidobacterium breve
MEVRTIMRKKFVAAVAAFAALCGMVSVPANAAETTQPIREDVTPHVLVPIPVPESKLVSEPEPVDIDALAAAVIRGEYGDGEARRAALGDNYDAVQARVNELVPVAAPVVSQPVQAAPVVSQSVQSAPAQSVPQAAPRSYTFEDVYSLAVNSPYCELEDGSDLPQCYWHDGAGDGSEPPYTDIVYMPDGYGYQAHEDTMTVSVFARNPWL

SEQ ID NO: 600 - protein, 204 aa, Bifidobacterium breve
MRKKFVAAVAAFAALCGMVSVPANAAETTQPIREDVTPHVLVPIPVPESKLVSEPGPVDIDALAAAVIRGEYGDGEARRAALGDNYDAVQARVNELVPVAAPVVSQPVQAAPVVSQSVQSAPAQSVPQAAPRSYTFEDVYNLAVNSPYCELEDGSDLPQCYWHDGAGDGSEPPYTDIVYMPDGYGYQAHEDTMTVSVFARNPWL

SEQ ID NO: 601 - protein, 545 aa, unidentified
  REGION 1..545: note = Kribbibacterium absianum
MGLNGIDISSWQDDLVVSNMGTCDFVIVKATGGAGYSNECFRRHADETLAAGKLLGCYHYARDRGYEGSAEAEADHFIDAFRPYIGKAIPFLDWEADAIDLGPSWAKRWLDRVKAKTGVTPGIYTSKSVLFSFDWSGVAKAYPLWVAQYPNYEDTGFVSEPWTDGWDFGAWDSPLIFQYTGTGRIPGYGGHLDLDLFYGTHDDWRRLCAVAGAFAGTKEADTVTISRANVAAQIMEHLCSCPEHGYSQPGRHGTSGHCSVNTDAGTIKVTKGDRDCSSAVCEAWELALAGSPYDGLITRYNWTGGMREMFVGSGLFSWEPMSFNASRGDIYLDEENHTAMCIRNDGAADLLGEFSISETGGIDGEAGDQTGRESWVHDYYSGSWDGVLHYNGKADKGGAPGGSGSGAPSGDVSELAERVIAGEFGNGDARRAALGDRYDEVQAEVNRILLGGGSGIDVDAMARRVIAGEFGNGDERKRRLGSNYDAVQRRVNEILLGSGSSSTSMDVDAMARAVIRGDYGNGDERRRRLGSYYSIVQARVNEMLS

SEQ ID NO: 602 - protein, 194 aa, Bifidobacterium longum
MRNRFVAAVAAFAALCGMVSGQANAAETTQPIREDVTPHVLVPIPVPESKLVSEPEPVDIDALAAAVIRGEYGDGEARRAALGDNYDAVQARVNELVPVAAPVVSQPVQAAPAQSVPQAAPRSYTFEDVYNLAVNSPYCELEDGSDLPQCYWHDGAGDGSEPPYTDIVYMPDGYGYQAHEDTMTVSVFARNPWL

SEQ ID NO: 603 - protein, 272 aa, unidentified
  REGION 1..272: note = Tractidigestivibacter montrealensis
MRDWAKCVADLDLLMQKHFTSGRSGYKIRHVVIHYNAADGTVEDVHSWWQTRTASAHYQVESSGRIGQLVWDRDTAWHAGNWAENCQSIGIEHANRPDGTITEACLDNGAHLTAALCRLYGLGRPQWDVNVFPHKHFASTSCPGEIYGSQKSAYIERAQLWYDRMTGLGDSKPESAPSAPSSDIDALAREAIAGKYGNGDARRAALGSNYAAVQTRVNEIFGGKTASSSSSVDVDALARAVIRGDYGNGEERRRRLGADYAAVQKRVNELLS

SEQ ID NO: 604 - protein, 37 aa, unidentified
  REGION 1..37: note = Mobiluncus holmesii
MADAVIRGEYGNGEERKRRLGNLYSAVQARVNAKLGY

SEQ ID NO: 605 - protein, 37 aa, Trueperella pyogenes
MADAVIRGEYGNGAERRNRLGHLYDAVQAIVNRKLGY

SEQ ID NO: 606 - protein, 547 aa, unidentified
  REGION 1..547: note = Coriobacteriaceae bacterium CHKCI002
MGLNGIDISSWQDDLVVSGMTTCDFVIVKATGGAGYANECFLRHADETLAAGKLLGCYHYARDRGYEGSAEAEADWFISAFKPYVGKAIPFLDWEADALGLGPSWAKKWLDRVREKTCVTPGIYTSKSVLFSYDWTAVAKTYPLWVAQYPNYEDTGFVSEPWTDGWDFGAWESPLIFQYTGTGRITGYGGHLDLDLFYGTRDDWRRLCAVAGASAVTEEVKTVSISRANVAAQIMEHLCNCAEHGYSQPGRHGTSGHCNVQTDAGTIRVTKGDRDCSSAVCEAWELALAGSPYDGLITRYNWTGGMREMFVGSGLFSWKPISFNAQRGDIYLDESAHTAMCVRNDGTADLLAEFSISETGGIDGEPGDQTGRESWVHDYYSGRWDGILHYNGKADVGSASTPTGSGAPSGDVSELAARVIAGDFGNGDARRAALGSRYDGVQAEVNRILSGGSSSGSYDVDALARRVIAGEFGNGDDRKRRLGDKYSAVQKRVNEILGALGASSTSMDVDAMARAVIRGDYGNGEERRRRLGSYYSIVQRRVNEMLS

SEQ ID NO: 607 - protein, 306 aa, unidentified
  REGION 1..306: note = Caudoviricetes sp.
MSYQQSFIPANPSNYTKGRGGKRITTIVIHHWDDPARNPQLSGVIATFQNPGRGASAHFVVEAGRVVQMVDLANTAWHAGNWPINQCSIGIECNPRCTDADKATIGELIRNLQATYGPLRIIGHKDASSTACPGRYYPPASVLGPYITGGGGPVGPTPSVGGDIESLAQAVIRGEYGYGEDRKARLGSQYSAVQARVNEILAGRASKPAASAAPAPDIDALADAVIRGDYGNGEDRKARLGHLYDAVQARVNAKLSGSAPAPVPGPNLDALADAVIRGDYGNGAERRNRLGHLYDAVQAIVNRKLS

SEQ ID NO: 608 - protein, 208 aa, unidentified
  REGION 1..208: note = Bacteriophage sp.
MSFDFITQYDSPNYTVGRPYGIACIVIHWWGDPAEHPTFEGVINTLCSPSRGASANYVAEAGRVACLVDPDNRSWASGDGINVNSMGNDRGISIECNPRQSDGDYQTIGELIANIRSVYGDLPLYRHRDFSATECPGTYDLARLDAIARGTTVSQPSAPAAPSAPSVDIDALANAVIRGDYGVGEERRARLGANYDAVQNRVNQILLG

SEQ ID NO: 609 - protein, 343 aa, unidentified
  REGION 1..343: note = Caudoviricetes sp.
MQMTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSRIAPNHALWVAQYANENQTGYQDSPWLPDGGFGAWNTCVMHQYSSHGRLSGYNGNLDLDIAFMDAAAWSRYAKPSTYSAPDATDNKNSGSTVDLAAGVMRGEYGNGDERKAKLGARFNEVQDLINRAATASADDLATDVLNGKLGNGETRKAILGIRYDEVQAVVNSRAKAVDIDALARAVIRGEYGNGDERKARLGANFNAVQKRVNELL

SEQ ID NO: 610 - protein, 252 aa, unidentified; identical to SEQ ID NO: 140
  REGION 1..252: note = Caudoviricetes sp.

SEQ ID NO: 611 - protein, 340 aa, unidentified
  REGION 1..340: note = Caudoviricetes sp.
MKGIDISDYQRGLDLTKIDYDFVFCKATEGIDKVYSTCDPFIQTAISQKKLYGFYHFLDQSDPVKQAEFFYANCKNYFGRGIPMLDYEAYGRIGTDKAKLFLDKIYELTGVRCIVYMSRSVTTEEDWSQIAKNHALWVAQYADRNDTGYQDSPWLPDGGFGAWNSCVIHQYSSHGRLNGYDKYLDLDIAYMDKQAWFKYVHGEKVETGGAAENCPDGSTANLAAAVMRGEYGNGDERRKRLGSRYDEVQALINRVSSSSVDDLAKDVLNGVFGNGDTRRAVLGSRYDEVQARVNARSSSVDIDALARAVIRGEYGDGNERHTKLGANFDAVQKRVNELLK

SEQ ID NO: 612 - protein, 343 aa, unidentified
  REGION 1..343: note = Caudoviricetes sp.
MQMTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYSAPDATDNKNSGSTVDLAAGVMRGEYGNGDERKAKLGARFNEVQDLINRAATASADDLATDVLNGKLGNGETRKAILGIRYDEVQAVVNSRAKAVDIDALARAVIRGEYGNGDERKARLGANFNAVQKRVNELL

SEQ ID NO: 613 - protein, 343 aa, unidentified
  REGION 1..343: note = Caudoviricetes sp.
MQMTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFIDAAAWSRYAKPGTYNAPAATDNEHGSSTADLAAGVMRGEYGNGDERKAKLGARFNEVQDLINRTATASADDLATDVLNGKLGNGETRKVILGIRYDEVQAVVNSRVNAVDIDALARAVIRGEYGNGDERKARLGANFNAVQKRVNELL

SEQ ID NO: 614 - protein, 274 aa, unidentified
  source 1..274: note = Actinomyces urogenitalis DORA_12
PMDAILSARPFRESHAVLESTKPSTDPIDKIVLHHNAGTLSIRGCYDVWQTREASAHYQVDVNGRIGQLVWDRDTAWHAGNLAANRTSIGIEHANATSTTSPITEATLDAGAHLVAAICIRYRLGRPAWGVNVFGHKHFSATACPGHIAGDQNSAYMARAQHWYDQMTGTATPTPPPPAPAPAPDLDALADAVIRGEYGNGDERRHRLGNLYDQVQQRVNAKLTGSAPAPSAGPDLDALADAVIRGDYGNGDERRHRLGNLYDAFQARVNAKLS

SEQ ID NO: 615 - protein, 300 aa, unidentified; identical to SEQ ID NO: 148
  REGION 1..300: note = Paludibacteraceae bacterium

SEQ ID NO: 616 - protein, 547 aa, Olsenella sp.; identical to SEQ ID NO: 136

SEQ ID NO: 617 - protein, 124 aa, unidentified
  REGION 1..124: note = Atopobiaceae bacterium
MAGEFGNGDARRQALGSRYDEVQAEVNRILGYGAVDVDALARRVIAGEFGNGDERKRRLGSNYDAVQTRVNEILGAAGTSSTSVDVDAMARAVIRGDYGNGEERRRRLGSYYSIVQARVNEMLS

SEQ ID NO: 618 - protein, 225 aa, unidentified
  REGION 1..225: note = Atopobiaceae bacterium
MALGGGKIGHFTGSETGGIDDAPGDQTGRESRIQDYYRGSWDGVLHYNGKADVGGASTPTGSGVPSGDVSELAARVIAGEFGNGDARRAALGNRYDEVQAEVNRILLGGSSGGSYDVDALARRVIAGEFGNGDASSVKQTPRRGVCSEKARASSERCQCLGDRYSAVQRRVNEILGAAGASSASMDVDAMARAVIRGDYGNGEERRRRLGSYYSIVQRRVNEMLS

SEQ ID NO: 619 - protein, 306 aa, unidentified
  REGION 1..306: note = Actinomyces sp. oral taxon 181
MSYQQSFIPANPSNYTKGRGGKRITTIVIHHWDDPARNPQLSGVIATFQNPGRGASAHFVVEAGRVVQMVDLANTAWHAGNWPINQCSIGIECNPRCTDADKATIGELIRNLQATYGPLRIIGHKDASSTACPGRYYPPASVLGPYITGGGSPVGPAPSVGGDIESLAQAVIRGEYGNGEDRKARLGSQYSAVQARVNEILAGRASKPAASAAPAPDIDALADAVIRGDYGNGEDRKARLGHLYDAVQARVNAKLSGSAPDPVPGPNLDALADAVIRGDYGNGAERRNRLGHLYDAVQAIVNRKLS

SEQ ID NO: 620 - protein, 545 aa, unidentified
  REGION 1..545: note = Coriobacteriaceae bacterium
MGLNGIDISSWQDDLIVSNMGTCDFVIVKATGGAGYSNECFRRHADETLAAGKLLGCYHYARERGYEGSAEAEADHFIDAFRPYVGRAIPFLDWEADALDLGPSWAKKWLDRVKFKTGVTPGIYTSKSVLFSYDWTAVAKAYPLWVAQYPNYEDTGFTSEPWTDGWDFGAWDSPLIFQYTGTGRVPGYRRHLDLDLFYGTHDDWRRLCAVAGASAGTKEEDTVSISRANVAAQIMEHLCSCPEHGYSQPGRHGTSGHCSVNTDAGTIKVTKGDRDCSSAVCEAWELALSGSAYDGLITRYNWTGGMREMFVGSGLFSWEPMSFNASRGDIYLDEENHTAMCIRNDGTADLLGEFSISETGGIDGEPGDQTGRESWVHDYYSGSWDGILHYNGKADTGGAPGGSGSGAPSGDVSELAERVIAGEFGNGDARRAALGSRYDEVQAEVNRILLGGGSGIDVDAMARRVIAGEFGNGDERKRRLGSNYDAVQRRVNEILLGTGSSPTSMDVDAMARAVIRGDYGNGEERRRRLGSYYSIVQARVNEMLS

SEQ ID NO: 621 - protein, 334 aa, unidentified
  REGION 1..334: note = Coriobacteriales bacterium
MAGASAAEEVEEVSISRANVAAQIMEHLCNCAEHGYSQPGRHGTSGHCNVATDASTVKVTKGDRDCSSAVCEAWELALAGTAYDGLITRYNWTGGMREMFVGSGLFSWKSMSFNASRGDIYLDEENHTAMCIRNDNTADLLGEFSISETGGIDGEPGDQTGRESWVHDYYSGSWDGILHYNGKADGGAVDGGADTPSGDVADLARMVIAGEFGNGDARKTALGSRYDEVQAEVNRILLGGESSGIDVDAMARRVIAGEFGNGDERKRRLGSNYDAVQRRVNEILGSAGTSSTSIDVDAMARAVIRGDYGNGEERKRRLGSYYSIVQARVNQMLS

SEQ ID NO: 622 - protein, 341 aa, Collinsella sp.
MTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYSAPDATDNKNNGSTVDLAAGVMRGEYGNGDERKAKLGARFNEVQDLINRAATASADDLATDVLNGKLGNGETRKAILGIRYDEVQAVVNSRAKAVDIDALARAVIRGEYGNGDERKARLGANFNAVQKRVNELL

SEQ ID NO: 623 - protein, 339 aa, Collinsella sp.
MKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYSAPDATDNKNNGSTVDLAAGVMRGEYGNGDERKAKLGARFNEVQDLINRAATASADDLATDVLNGKLGNGETRKAILGIRYDEVQAVVNSRAKAVDIDALARAVIRGEYGNGDERKARLGANFNAVQKRVNELL

SEQ ID NO: 624 - protein, 74 aa, Bifidobacterium sp.
DRMARLKQAGYDAQAVQNRVNALLGVSTPSPNVDLNALADAVIRGEYGNGEERQRRLGSNYAAVQAIVNRKMGW

SEQ ID NO: 625 - protein, 547 aa, unidentified
  REGION 1..547: note = Eggerthellaceae bacterium
MGLNGIDISSWQDDLVVSAMATCDFVIVKATGGAGYANECFRRHADETLAAGKLLGCYHYARDRGYEGSAEAEADWFIEAFRSYIGKAIPFLDWEADALGLGPVWAKAWLDRVREKTGVTPGIYTSKSVLFSYDWSSVAKTYPLWVAQYPNYEDTGFVSEPWTDGWDFGAWESPLIFQYTGTGRITGYGGHLDLDLFYGNKDDWRRLCAVAGASAGTEEVKTVSISRANVAAQIMEHLCTCPLHGYSQPGRHGTSGHCNVNTDAGTVRVTKGDRDCSSAVCEAWELALAGSPYDGLITRYNWTGGMREMFVGSGLFSWKPMSFNAQRGDIYLDESSHTAMCIRNDGTADLLAEFSISETGGIDGEPGDQTGRESWVHDYYTGHWDGILHYNGKADVGSASTPTGSGAPSGDVSELAARVIAGEFGNGDARRAALGSRYDEVQAEVNRILSGASSSGSYDVDALARRVIAGEFGNGDERRRRLGDKYSAVQKRVNEILGASGASSTSMDIDAIARAVIRGDYGNGEERRRRLGSYYSIVQARVNEMLS

SEQ ID NO: 626 - protein, 544 aa, unidentified; identical to SEQ ID NO: 132
  REGION 1..544: note = Eggerthellaceae bacterium

SEQ ID NO: 627 - protein, 122 aa, unidentified
  REGION 1..122: note = Collinsella sp. An268
MSRYSEVQAEVSRILAGGSGGDASQVPAADDVDDLARRVIAGEFGNGAARKAALGDRYAEVQARVNEMLGAGGFSGGSSDGADVDALARAVIRGDYGNGAERKRRLGSLYGAVQARVNEILS

SEQ ID NO: 628 - protein, 310 aa, unidentified
  REGION 1..310: note = Corynebacterium diphtheriae subsp. lausannense
MSYQQSFTPAHPSNYTRGRGGKRITTIVIHHWDDPARNPQLSGVIATFQNPGRGASAHFVVEAGRVVQMVDLANTAWHAGNWPINQCSIGIECNPRCSDADKATIGELIRNLQATYGPLKIIGHKDASSTACPGRYYPPAQVLAPYINGGGSPAAPAPSVGGDIEALAQAVIRGEYGNGEDRKARLGHLYEAVQARVNEILAGRASKPAASAPASPAPAPDIEALADAVIRGDYGNGEDRKARLGHLYEAVQARVNAKLSGSAPAPAPGPNLEALADAVIRGEYGNGAERRNRLGHLYDAVQAIVNRKLS

SEQ ID NO: 629 - protein, 208 aa, unidentified
  REGION 1..208: note = Bacteriophage sp.
MSFDFITQYDSPNYTVGRPYGIACIVIHWWGDPAEHPTFEGVINTLCSPSRGASANYVAEAGRVACLVDPDNRSWASGDGINVNSMGNDRGISIECNPRQSDGDYQTIGELIANIRSVYGDLPLYRHRDFSATECPGTYDLARLDAIARGTAVSQPSAPAAPSAPSVDIDALANAVIRGDYGVGEERRARLGANYDAVQNRVNQILLG

SEQ ID NO: 630 - protein, 343 aa, unidentified
  REGION 1..343: note = Bacteriophage sp.
MQMTMKGIDIADWQKTLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFIDAAAWSRYAKPGTYNAPAATDNEHGSSTADLAAGVMRGEYGNGDERKAKLGARFNEVQDLINRTATASADDLATDVLNGKLGNGETRKVILGIRYDEVQAVVNSRVNAVDIDALARAVIRGEYGNGDERKARLGANFNAVQKRVNELL

SEQ ID NO: 631 - protein, 343 aa, unidentified
  REGION 1..343: note = Bacteriophage sp.
MQMTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSRIAPNHDLWVAQYANENQTGYQDSPWLPDGGFGAWNTCVMHQYSSHGRLSGYNGNLDLDIAFMDAAAWSRYAKPSTYNAPAATDNENCGRTVDLAAGVMRGEYGNGDERKAKLGARFNEVQDLINRTATASADDLATDVLNGKLGNGETRKVILGIRYDEVQAVVNSRVNAVDIDALARAVIRGEYGNGDERKARLGANFNAVQKRVNELL

SEQ ID NO: 632 - protein, 341 aa, unidentified
  REGION 1..341: note = Bacteriophage sp.
MTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSRIAPNHALWVAQYANENQTGYQDSPWLPDGGFGAWNTCVMHQYSSHGRLSGYNGNLDLDIAFMDAAAWSRYAKPSTYSAPDATDNKNSGSTVDLAAGVMRGEYGNGDERKAKLGARFNEVQDLINRAATASADDLATDVLNGKLGNGETRKAILGIRYDEVQAVVNSRAKAVDIDALARAVIRGEYGNGDERKARLGANFNAVQKRVNELL

SEQ ID NO: 633 - protein, 343 aa, unidentified
  REGION 1..343: note = Bacteriophage sp.
MQMTMKGIDIADWQKNLNLDSIEYDFVIIKGTQGTNYVNTFCDAFVQKAIKAGKLWGFYHFMNMDDPVKQADHFYQNCKNYFGKGIPVLDYEDGGRIGTDGAKKFLDRIYALTGVRCLLYTYRNLTKEEDWSRIAPNHALWVAQYANENQTGYQDSPWLPDGGFGAWNTCVMHQYSSHGRLSGYNGNIDLDIAFMDAAAWSRYAKPSTYNAPAATNNENCGRTVDLAAGVMRGEYGNGDERKAKLGARFNEVQDLINRTATASADDLATDVLNGKLGNGETRKVILGIRYDEVQAVVNSRVNAVDIDALARAVIRGEYGNGDERKARLGANFNAVQKRVNELL

SEQ ID NO: 634 - protein, 271 aa, Mobiluncus curtisii
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPVWGKNVFGHRDFSATECPASIAGSQHGAYMARAGYWYDQISGNKPQASSAGKPDIEALANAVIRGEYGNGDQRRARLGGLYDAVQARVNEILGLKSKPAGKSIETLAREVIRGDWGNGQERYNRLTNAGYNYQQVQNRVNQILA

SEQ ID NO: 635 - protein, 278 aa, Corynebacterium caspium; identical to SEQ ID NO: 135

SEQ ID NO: 636 - protein, 280 aa, Bifidobacterium pseudolongum
MKNWDKLEADRDLILNKHFTGGRNGCRIDKVILHHNGGNLSGEGCYNVWQTREASAHYQVDANGVITQIVWDGDTAWHAGNYQANCTSIGIEHADICTNPWKISDATLDNGAHLTAAVCKYYGLGRPQYGKNVFFHKDFSPTECPASIAGSQRDAYMRRAQEWYDRMTGSKPSSPAKPAAKPSAPSKKSVETVAREVIAGQWGNGDDRMNRLRKAGYDAQAVQDRVNALLGVSTPSANVDLNALADAVIRGEYGNGAERQRRLGSNYAAVQAIVNRKMGW

SEQ ID NO: 637 - protein, 547 aa, Olsenella uli
MGLNGIDISSWQDDLVVSAMGTCDFVIVKATGGAGYSNECFRRHADETLAAGKLLGCYHYARDRGYEGSAEAEADHFISAFKPYVGKAIPILDWEADALDLGPAWAKKWLDRVRAKTGVTPGIYTSKSVLFSYDWAAVAKTYPLWVAQYPNYEETGFLSEPWTDGWDFGAWSSPLIFQYTGTGRIPGYGGHLDLDLFYGTRDDWRRLCAVAGASAGTGEVKEVAISRANVAAQIMEHLCNCAEHGYSQPGRHGTSGHCSVQTDAGVVKVTKGDRDCSSAVCEAWELALAGTTYDGLITRYNWTGGMREMFVGSGLFSWKPMSFNASRGDIYLDEENHTAMCIRNDGTADLLGEFSISETGGIDGEPGDQTGRESWVHDYYSGHWDGILHYNGKADGTAAPGESGSGAPSGNVSELAARVIAGDFGNGDARVAALGDRYEEVQAEVNRILLGGSSGGSYDVDAMARRVIAGEFGNGDERRRRLGDKYSAVQKRVNEILGASGTSSTSMDVDAMARAVIRGDYGNGEERRRRLGSYYSVVQRRVNEMLS

SEQ ID NO: 638 - protein, 312 aa, unidentified
  REGION 1..312: note = Actinomycetes
MSYQQSFTPAHPSNYTKGRGGKRITTIVIHHWDDPARNPQLSGVIATFQNPGRGASAHFVVEAGRVVQMVDLANTAWHAGNWPINQCSIGIECNPRCSDGDKATIGELIRNLQATYGPLRIIGHKDASSTACPGRYYPPASVLGPYITGGGSPTAPAPSVGGDIESLAQAVIRGEYGNGEDRKVRLGSQYSAVQARVNEILAGRASKPAPSAPASPAPAPAPDIEALADAVIRGDYGNGEDRKARLGHLYEAVQARVNAKLSGSAPAPAPGPNLEALADAVIRGEYGNGAERRNRLGHLYDAVQAIVNRKLS

SEQ ID NO: 639 - protein, 314 aa, unidentified
  REGION 1..314: note = Thermophilibacter mediterraneus
MAYSILFKQCGSDHMTRGRSRAVDRIVVHFTATLASARNNATYFARNEVQGASAHYFVDDITPEIYQSVAEGDTAWHAGDWQMNCRAIGIEVVSAGEDFSATEVEKLGWLVRRLMAKYGIGASGVIRHYDVTGKLCPAPYVAASKWAALKARITGGGSSGGTTEAAPSGTVAELARRVIAGEFGNGDARRAALGSRYDEVQAEVNRILAGGSGGGAAQAPAADDVDDLARRVIAGEFGNGKARRAALGDRYAEVQARVNEMLGAGGSGGSSGGADVDALARAVIRGDYGNGAERKRRLGSLYGAVQARVNEILS

SEQ ID NO: 640 - protein, 255 aa, unidentified
  REGION 1..255: note = Boudabousia liubingyangii
MSYTIDHSHDATAFTTGRQGHRIKYIVVHHWDDPAKHPTFEGTIRWFERGGNNTSAHYVVEAGRVAQLVADGNTAYHAGNWVKNLESIGIECNPRCSDADKETVAELIRDLQAKYGPLTILGHKDCSSTDCPGRYYPPARVLAPWLGGGGGNAKPATHASTPSGDLNALADAVLRGDYGNGEERRRRLGSKYSAVQAIVNQRLGYGSTPASAGSDLNALADAVIRGDYGNGDERRRRLGANYAAVQALVNRKLGY

SEQ ID NO: 641 - protein, 273 aa, Bifidobacterium pseudolongum
MKNWDKLEADINLILDRHFTGGRNGCKIDKVILHHNGGNLSGEGCYEVWQTREASAHYQVDANGGITQLVWDSDTAWHAGNYQANCTSIGIEHADISTNPWKISDATLDNGAHLTAAVCKHYGLGRPQYGKNVFFHKDVSATECPASIAGSQRDAYMRRAQEWYDRMTEGKPAAPSAPAKKSVETVAREVIAGQWGNGDDRMNRLRQAGYDTQAVQNRVNALLGVSTPSANVDLNALADAVIRGEYGNGAERQRRLGSNYAAVQAIVNRKMGW

SEQ ID NO: 642 - protein, 278 aa, Bifidobacterium pseudolongum
MKNWDKLEADKNLILDKHFTGGRNGCKIDKVILHHNGGNLSGEGCYQVWQTREASAHYQVDANGSVTQLVWDSDTAWHAGNYQANCTSIGIEHADISTNPWKISDATLDNGAHLTAAVCKHYGLGRPQYGKNVFFHKDFSATECPASIAGSQRDAYMRRAQEWYDKMIGNKPTASAPAKPSAPAKKSVETVAREVIAGQWGNGNDRMTRLKNAGYDANAVQTRVNQLLGVSTPSPNVDLNALADAVIRGEYGNGAERQRRLGSNYAAVQAIVNRKMGW

SEQ ID NO: 643 - protein, 278 aa, Bifidobacterium pseudolongum
MKNWDKLEADLNLILDKHFTGGRDGRRIDKVVLHHNGGNLTGQGCYNVWQTRQASAHYQVDSNGVISQHVWDSDTAWHAGDWGANCTSIGIEHADISTNPWRISDACLDNGAHLTAAVCKAYGLGRPAYGRNVFYHKDFSATECPASIAGSQRDAYMRRAQEWYDKMTGNKPAASAPAKPSTPAKKNVETVAREVIAGQWGNGADRMTRLKNAGYDANAVQNRVNALLGVSTPSPNVDLNALADAVIRGEYGNGAERQRRLGSNYAAVQAIVNRKMGW

SEQ ID NO: 644 - protein, 278 aa, Bifidobacterium pseudolongum
MKNWDKLEADKNLILDKHFTGGRNGCKIDKVILHHNGGNLSGEGCYQVWQTREASAHYQVDANGGVTQLVWDSDTAWHAGNYQANCTSIGIEHADISTNPWKISDATLDNGAHLTAAVCKHYGLGRPQYGKNVFFHKDFSATECPASIAGSQRDAYMRRAQEWYDKMTGNKPTASAPAKPSAPAKKSVETVAREVIAGQWGNGNDRMTRLKNAGYDAQAVQNRVNALLGVSTPSPNVDLNALADAVIRGEYGNGAERQRRLGSNYAAVQAIVNRKMGW

SEQ ID NO: 645 - protein, 278 aa, Bifidobacterium pseudolongum
MKNWDKLEADENLILDKHFTGGRDGRKIDKVVLHHNGGNLTGQGCYTVWQTRQASAHYQVDSNGVISQHVWDSDTAWHAGNWDANTTSIGIEHADISTNPWRISDACLDNGAHLTAAVCKAYGLGRPAYGRNVFYHKDFSATECPASIAGSQRDAYITRAQEWYDKMTGNKPAASAPAKPSTPAKKSVETVAREVIAGQWGNGNDRMARLKQAGYDAQAVQNRVNALLGVSTPSPNVDLNALADAVIRGEYGNGEERQRRLGSNYAAVQAIVNRKMGW

SEQ ID NO: 646 - protein, 278 aa, Bifidobacterium pseudolongum
MKNWDKLEADKNLILDKHFTGGRNGCKIDKVILHHNGGNLSGEGCYQVWQTREASAHYQVDANGGVTQLVWDSDTAWHAGNYQANCTSIGIEHADISTNPWKISDATLDNGAHLTAAVCKHYGLGRPQYGKNVFFHKDFSATECPASIAGSQRDAYMRRAQEWYDKMTGNKPTASAPAKPSAPAKKSVETVAREVIAGQWGNGNDRMTRLKNAGYDANAVQTRVNQLLGVSTPSPNVDLNALADAVIRGEYGNGAERQRRLGSNYAAVQAIVNRKMGW

SEQ ID NO: 647 - protein, 278 aa, Bifidobacterium pseudolongum
MKNWDKLEADKNLILDKHFTGGRNGCKIDKVILHHNGGNLSGEGCYQVWQTREASAHYQVDANGSVTQLVWDSDTAWHAGNYQANCTSIGIEHADISTNPWKISDATLDNGAHLTAAVCKHYGLGRPQYGKNVFFHKDFSATECPASIAGSQRDAYMRRAQEWYDKMTGNKPTASAPAKPSAPAKKSVETVAREVIAGQWGNGNDRMTRLKNAGYDANAVQTRVNQLLGVSTPSPNVDLNALADAVIRGEYGNGAERQRRLGSNYAAVQAIVNRKMGW

SEQ ID NO: 648 - protein, 547 aa, unidentified
  REGION 1..547: note = Gordonibacter urolithinfaciens
MGLNGIDISSWQDDLVVSGMTTCDFVIVKATGGAGYANECFLRHADETLAAGKLLGCYHYARDRGYEGSAEAEADWFISAFKPYVGKAIPFLDWEADALGLGPSWAKKWLDRVREKTCVTPGIYTSKSVLFSYDWTAVAKTYPLWVAQYPNYEDTGFVSEPWTDGWDFGAWESPLIFQYTGTGRITGYGGHLDLDLFYGTRDDWRRLCAVAGASAVTEEVKTVSISRANVAAQIMEHLCNCAEHGYSQPGRHGTSGHCNVQTDAGTIRVTKGDRDCSSAVCEAWELALAGSPYDGLITRYNWTGGMREMFVGSGLFSWKPISFNAQRGDIYLDESAHTAMCVRNDGTADLLAEFSISETGGIDGEPGDQTGRESWVHDYYSGRWDGILHYNGKADVGSASTPTGSGAPSGDVSELAARVIAGDFGNGDARRAALGSRYDEVQAEVNRILSGGSSSGSYDVDALARRVIAGEFGNGDDRKRRLGDKYSAVQKRVNEILGALGASSTSMDVDAMARAVIRGDYGNGEERRRRLGSYYSIVQRRVNEMLS

SEQ ID NO: 649 - protein, 274 aa, Bifidobacterium dentium
MASVAEFIQCDSRNYTAGRQGNRIRKIVVHYTGTEASAHNNLLYFSRSSAGASAHYFIDKDGTLRQLVSEGDTAWHAGHWATNLCSVGIEVVSGGADFTEAQINTLATPVADIRSRCGVSADDVIRHYDVTGKLCPAPYVDGSKWAALHERICGGAASSGGGSGSGGSGSGGSGGGPAPSGDVSELARRVINGEFGNGDVRKAALGSSYSAVQTRVNEMLGCGSSGGGSGSAGVDIDALARAVINGDYGNGEECRQRLGANYAAVQRRVNEMLS

SEQ ID NO: 650 - protein, 324 aa, unidentified
  REGION 1..324: note = Corynebacterium belfantii
MRPKNQKENCQPNPQQTQQSFTPAHPSNYTRGRGGKRITTIVIHHWDDPARNPQLSGVIATFQNPGRGASAHFVVEAGRVVQMVDLANTAWHAGNWPINQCSIGIECNPRCSDADKATIGELIRNLQATYGPLKIIGHKDASSTACPGRYYPPAQVLAPYINGGGSPAAPAPSVGGDIEALAQAVIRGEYGNGEDRKARLGHLYEAVQARVNEILAGRASKPAASAPASPAPAPDIEALADAVIRGDYGNGEDRKARLGHLYEAVQARVNAKLSGSAPAPAPGPNLEALADAVIRGEYGNGAERRNRLGHLYDAVQAIVNRKLS

SEQ ID NO: 651 - protein, 257 aa, unidentified
  REGION 1..257: note = Rothia sp. ZJ1223
MSYTIDHSHDATAFTRGRQGHRIKYIVVHHWDDPAKHPTFEGTIRWFERGGNNTSAHYVAEAGRVAQLVADGNTAYHAGNWVKNLESIGIECNPRCNEADKATVAELIRDLQAKHGPLTILGHKDCTSTDCPGRYYPPTSVLAPWLGGGGGAGNAKPATTTTAPSGDLNALADAVLRGDYGNGEERKRRLGSKYSAVQAIVNQRLGYGSATTSAGPDLNALADAVIRGEFGNGDERRRRLGANYAAEQRIVNRKLGY

SEQ ID NO: 652 - protein, 311 aa, unidentified
  REGION 1..311: note = Schaalia sp. lx-100
MSYQQSFTPAHPSNYTRGRGGKRITTIVIHHWDDPAKNPQLSGVIATFQNPGRGASAHFVVEAGRVVQMVDLAHTAWHAGNWPVNQCSIGIECNPRCSDADKATIGELIRNLQATYGPLKIIGHKDASSTACPGRYYPPASVLGPYITGGGRPAAPAPSVGGDIEALAQAVIRGEYGNGEERKARLGSQYSAVQARVNEILAGRASQPAPSAPANPTPAPDIEALADAVIRGDYGNGADRKARLGHLYDAVQARVNAKLSGAAPSAPAPGPNLEALADAVIRGEYGNGAERRNRLGHLYDAVQAIVNRKLS

SEQ ID NO: 653 - protein, 62 aa, unidentified
  REGION 1..62: note = Actinomycetaceae
MQARVNEKLAGRAPAAKPAGPNIDALADTVIRGEYGNGEDRKRRLGNLYSAVQARVNAKLGY

SEQ ID NO: 654 - protein, 112 aa, Bifidobacterium pseudolongum
MTGNKPTASAPAKPSTPAKKSVETVAREVIAGQWGNGNDRMARLEQAGYDAQAVQNRVNALLGVSTPSPNVDLNALADAVIRGEYGNGAERQRRLGSNYAAVQAIVNRKMGW

SEQ ID NO: 655 - protein, 278 aa, Bifidobacterium pseudolongum
MKNWDKLEADKNLILDKHFTGGRNGCKIDKVILHHNGGNLSGEGCYQVWQTREASAHYQVDANGGVTQLVWDSDTAWHAGTYQANCTSIGIEHADISTNPWKISDATLDNGAHLTAAVCKHYGLGRPQYGKNVFFHKDFSATECPASIAGSQRDAYMRRAQEWYDKMTGNKPTASAPAKPSAPAKKSVETVAREVIAGQWGNGNDRMTRLKNAGYDANAVQTRVNQLLGVSTPSPNVDLNALADAVIRGEYGNGAERQRRLGSNYAAVQAIVNRKMGW

SEQ ID NO: 656 - protein, 100 aa, unidentified
  REGION 1..100: note = Adlercreutzia sp. ZJ154
MPSDPSPDGIDDLARRVLAGEFGNGDERRTALGDKYSDVQSRVNEIFSTGLPSGSSSPSADIDALARAVINGDYGNGKERKRRLGSSYASVQRRVNELLA

SEQ ID NO: 657 - protein, 261 aa, unidentified
  REGION 1..261: note = Thermophilibacter sp. ET337
MAYSILFKQCGSDHMTRGRSRAVDRIVVHFTATLASARNNATYFARNEGQGASAHYFVDDVTPEIYQSVAEGDTAWHAGDWQMNCRAIGIEVVSAGEDFSATEVEKLGWLVKRLMAKYGIGASGVIRHYDVTGKLCPAPYVAASKWAALRAAITGGAASGGTTAAAPEGAVSDLARRVIAGEFGNGDARRAALGSRYDEVQAEVNRILAGGSGAPAQPAAPDVDTLARAVIRGDYGNGAERRRRLDSLYDAVQARVNEMLS

SEQ ID NO: 658 - protein, 258 aa, unidentified; identical to SEQ ID NO: 129
  REGION 1..258: note = Propionimicrobium lymphophilum

SEQ ID NO: 659 - protein, 312 aa, unidentified
  REGION 1..312: note = Actinomycetaceae
MGYSYSFDPASPANYTAGRGGKRITTIVIHHWDDPARNPQLAGVVATFKNPGRGASAHYVVEAGRVVQMVDLANTAWHAGNWPVNQCSIGIECNPRCSEADKATIGELIRDLQAKYGPLRIIGHKDASSTACPGRYYPPASVLAPYIGGGGSSAPAATPAVDGSIDELARRVIAGEFGNGEERKTRLGSQYSAVQARVNEILAGRPAQPNPAEPATPAPAADIEALADAVIRGEYGNGADRKARLGHLYDAVQARVNAKLSGAAPAPAPGPNLEAMADAVIRGEYGNGAERRNRLGHLYDAVQAIVNRKLGY

SEQ ID NO: 660 - protein, 252 aa, unidentified
  REGION 1..252: note = Corynebacterium belfantii
MSYQQSFTPAHPSNYTRGRGGKRITTIVIHHWDDPARNPQLSGVIATFQNPGRGASAHFVVEAGRVVQMVDLANTAWHAGNWPINQCSIGIECNPRCSDADKATIGELIRNLQATYGPLKIIGHKDASSTACPGRYYPPAQVLAPYINGGGSPAAPAPSVGGDIEALAQAVIRGEYGNGEDRKARLGHLYEAVQARVNAKLSGSAPAPAPGPNLEALADAVIRGEYGNGAERRNRLGHLYDAVQAIVNRKLS

SEQ ID NO: 661 - protein, 543 aa, unidentified
  REGION 1..543: note = uncultured Enorma sp.
MGLNGIDISSWQDDLVVSAMGSCDFVIVKATGGAGYSNECFRRHADETLAAGKLLGCYHYARDHGYEGSAEAEADHFIAAFKPYVGKAIPFLDWEADALNLGPSWAKKWLDRVKAKTGVTPGIYTSKSVCFAYNWSGVAKTYPLWVAQYPNYEETGFLSEPWTDGWDFGAWDSPLIFQYTGTGRIPGYGGHLDLDLFYGTKDDWRGLCAVAGASAGAGEVKEVSISRANVAAQIMEHLCNCAEHGYSQPGRHGTSGHCNVQTDAGVVKVTKGDRDCSSAVCEAWELALVGSPYDGLITRYNWTGGMREMFVGSGLFSWQSVTANAARGDIYLDEENHTAMSLGGGKIGHFTGSETGGIDGEPGDQTGRESRIQDYYRGSWDGVLHYNGKADVGSASIPTGSGAPSGDVSELAARVIAGEFGNGDARKAALGDRYDEVQAEVNRILLGGSSGGSYDVDAMARRVIAGEFGNGDERKRRLGDRYSAVQRRVNEILDATGAGSTSMDVDAMARAVIRGDYGNGEERRRRLGSYYSIVQRRVNEMLS

SEQ ID NO: 662 - protein, 55 aa, Collinsella intestinalis
MLGAGGFSGGSSDGADVDALARAVIRGDYGNGVERKRRLGSLYGAVQARVNEILS

SEQ ID NO: 663 - protein, 342 aa, unidentified
  REGION 1..342: note = uncultured Senegalimassilia sp.
MTMKGIDISDYQRGINLAAIDYDFMICKATEGTSIVHTTCDPFIQKAIAMGKCWGFYHFMNKEDPIAQANYFYESCKGYFGAGIPILDYEMYGRIGTDGAKKFLDRIYELTGVRCIVYMSRSVCEEEDWSAIAPNHALWVAQYANDDTTCYQDSPWLPSGSFGAWSMCAIHQYTSHGRIDGYGGNLDLDIAYMDAAAWAKFANPNGGTPAHAPSNDPQGSTADLAAAVMRGEYGNGDDRRNRLGSRYDEVQNLINRAASASVDDLASDVLNGIFGNGDTRRAILADRYDDVQDRVNERANGVDIDALARAVIRGKYGDGDARRAALGSNYDAVQNRVNELLA

SEQ ID NO: 664 - protein, 315 aa, Collinsella tanakaei
MAYSILFKQCGSDHMTRGRSHAIDRIVVHFTATLASARNNATYFARNEGQGASAHYFVDDITPEIYQSVAEGDTAWHAGDWQMNCRAIGIEVVSAGEDFSATEVEKLGWLVRKLMARYGIGASGVIRHYDVTGKLCPAPYVAASKLAALKARITGGVVSGGTTPAAPDGTVAELARRVIAGEFGNGDARRTALGSRYSEVQAEVNRILAGGSGGGAAQAPASDDVDDLARRVIAGEFGNGATRKAALGDRYAEVQARVNEMLGAGGSSGGSSGGADVDALARAVIRGDYGNGAERKRRLGSLYGAVQARVNEILS

SEQ ID NO: 665 - protein, 214 aa, unidentified; identical to SEQ ID NO: 138
  REGION 1..214: note = Actinotignum urinale

SEQ ID NO: 666 - protein, 257 aa, unidentified
  REGION 1..257: note = uncultured Actinomyces sp.
MESTKPSTDPIDKIVLHHNAGTLSIRGCYDVWQTREASAHYQVDVNGRIGQLVWDRDTAWHAGNLAANRTSIGIEHANATSTTSPITEATLDAGAHLVAAICIRYRLGRPAWGVNVFGHKHFSATACPGHIAGDQNSAYMARAQHWYDQMTGTATPTPPPPAPAPAPDLDALADAVIRGEYGNGDERRHRLGNLYDQVQQRVNAKLTGSAPAPSAGPDLDALADAVIRGDYGNGDERRHRLGNLYDAFQARVNAKLS

SEQ ID NO: 667 - protein, 40 aa, Arcanobacterium hippocoleae
MDALADAVIRGDYGNGEERKRRLGNLYGAVQARVNAKLGY

SEQ ID NO: 668 - protein, 40 aa, Corynebacterium matruchotii
MEALADAVIRGEYGNGAERRNRLGHLYDAVQAIVNRKLGY

SEQ ID NO: 669 - protein, 271 aa, unidentified
  REGION 1..271: note = Actinotignum urinale
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDASLENGAHLVAALCHYYKLGRPVWGKNIFGHRDFSSTECPASIAGSQHANYMARASYWYDQISGNKPNPPSAGKPDIEALANAVIRGEYGNGDQRRARLGGLYDAVQARVNEILGFKAKPAGKSIETLAREVIRGDWGNGQERYNRLTNAGYNYQQVQNRVNQILS

SEQ ID NO: 670 - protein, 316 aa, unidentified
  REGION 1..316: note = Tractidigestivibacter sp.
MAYSILFKQCGSDHMTRGRSRAIDRIVVHYTGTTASARNNATYFSRNEGQGASAHYFVDDISPEIYQSVAEGDTAWHAGDWDMNCRAIGIEVVSAGEDYSGTEITKLAWLVQKLMAKYGIGSSGVIRHYDVTGKLCPAPYVAASKWAALKARITGGAAIPSGGEASAPSGTVAELARRVIAGEFGNGDARRAALGSRYDEVQAEVNRILAGGSGEDAAQAPGADDLDDLARRVIAGEFGNGAAREAALGDRYAEVQARVNEILGAGGSSGGSSGGVDIDSLARAVIRGDYGNGAERKRRLGALYDAVQARVNEILL

SEQ ID NO: 671 - protein, 90 aa, unidentified
  REGION 1..90: note = Ellagibacter isourolithinifaciens
MDDLARRVIAGEFGNGAARKAALGDHYAEVQARVNEMLGAGGSGGSSGSADIDVLARAVIRGDYGNGAERKRRLGSLYGAVQARVNEILS

SEQ ID NO: 672 - protein, 339 aa, Collinsella aerofaciens
MKGIDIADWQKNLNLDSIEYDFVIIKGTQGTNYVNTFCDAFVQKAIKAGKLWGFYHFMNMDDPVKQADHFYQNCKNYFGKGVPVLDYEDGGRIGTDGAKKFLDRIYALTGVRCLLYTYRNLTKEEDWSKIAPNHALWVAQYANENQTGYQDSPWLPDGGFGAWNTCVMHQYSSHGRLSGYNGNLDLDIAFMDAAAWSRYAKPSTYNAPVETAHENSGSTADLAAGVMRGKYGNGDERKAKLGTRFNEVQTLVNRAATASADDLATDVLNGKLGNGETRKVILGNRYDEVQAVVNSRVNAVDIDALAHAVIRGEYGNGDERKAKLGANFDAVQKRVNELL

SEQ ID NO: 673 - protein, 97 aa, unidentified
  REGION 1..97: note = Collinsella sp. An268
MPAADDVDDLARRVIAGEFGNGAARKAALGDRYAEVQARVNEMLGAGGFSGGSSDGADVDALARAVIRGDYGNGAERKRRLGSLYGAVQARVNEILS

SEQ ID NO: 674 - protein, 342 aa, unidentified
  REGION 1..342: note = Collinsella sp. CLA-ER-H7
MTMKGIDISDYQRGLDLTKIDYDFVFCKATEGIDKVYSTCDPFIQTAISQKKLYGFYHFLDQSDPVKQAEFFYANCKNYFGKGIPMLDYEAYGRIGTDKAKLFLDKIYELTGVRCIVYMSRSVTTEEDWSQIAKNHALWVAQYAGNNDTGYQDSPWLPDGGFGAWNSCIIHQYSSHGRLNGYDKYLDLDIAYMDKKAWFKYVHGERVDTGSAAENCPDGSTANLAAAVMRGEYGNGDERRKRLGYRYDEVQALINRASSSSVDDLAKDVLNGVFGNGDTRRAILGSRYDEVQERVNGYSSSVDIDALARAVIRGEYGDGSERRAKLGANFDAVQKRVNELLK

SEQ ID NO: 675 - protein, 306 aa, Actinomyces sp.; identical to SEQ ID NO: 619

SEQ ID NO: 676 - protein, 40 aa, Streptococcus anginosus
MDALADAVIRGDYGNGEERKRRLGNLYAAVQARVNAKLGY

SEQ ID NO: 677 - protein, 306 aa, unidentified
  REGION 1..306: note = uncultured Actinomyces sp.
MSYQQSFIPANPSNYTKGRGGKRITTIVIHHWDDPARNPQLSGVIATFQNPGRGASAHFVVEAGRVVQMVDLANTAWHAGNWPINQCSIGIECNPRCTDADKATIGELIRNLQATYGPLRIIGHKDASSTACPGRYYPPASVLGPYITGGGSPVGPAPSVGGDIESLAQAVIRGEYGNGEDRKARLGSQYSAVQARVNEILAGRASKPAASAAPAPDIDALADAVIRGDYGNGEDRKARLGHLYDAVQARVNAKLSGSAPAPVPGPNLDALADAVIRGDYGNGAERRNRLGHLYDAVQAIVNRKLS

SEQ ID NO: 678 - protein, 55 aa, unidentified
  REGION 1..55: note = Collinsella sp. An268
MLGAGGFSGGSSDGADVDALARAVIRGDYGNGAERKRRLGSLYGAVQARVNEILS

SEQ ID NO: 679 - protein, 252 aa, unidentified
  REGION 1..252: note = uncultured Actinomyces sp.
MSYQQSFIPANPSNYTKGRGGKRITTIVIHHWDDPAKNPQLSGVIATFQNPGRGASAHFVVEADRVVQMVDLANTAWHAGNWPINQCSIGIECNPRCSDADKATIGELIRNLQATYGPLKVIGHKDASSTACPGRYYPPASVLGPYITGGGSPAAPAPSVGGDIEALAQAVICGEYGNGEDRKARLGHLYDAVQARVNAKLSGSAPAPAPGPNLDALADAVIRGDYGNGAERRNRLGHLYDAVQAIVNRKLS

SEQ ID NO: 680 - protein, 33 aa, unidentified
  REGION 1..33: note = Olsenella sp. YH-ols2223
MALGYLGGNGEERKRRLGSYYSIVQRRVNEMLI

SEQ ID NO: 681 - protein, 197 aa, unidentified
  REGION 1..197: note = Duncaniella sp.
MKQFDLNKSSNRDFNLSKGGKRHFDLTKDEQVTPPAPEPTPEPEPDGKGSNWLLLIVGVVLIAALVWWIVPKGSDKEDAIAEEVHTEVISGAEETSIDEGVIDITASADSIVAQEEPEGDIENQSEMSESTSAKPEPVKQTASNVAATSAATGDVEEEALKVIRGEYGNGAVRRNNLGANYEAIQRRVNAMKRQGLF

SEQ ID NO: 682 - protein, 204 aa, Bifidobacterium longum
MRKKFVAAVAAFAALCGMVSVPANAAETTQPIREDVTPHVLVPVPVPESEPVSEPEPVNVDALAAAVIRGEYGDGEARRAVLGDNYDAVQARVNELVPVAAPVVSQPVQAAPVVSQSVQAAPAQSVPQAAPRSYTFEDVYNLAVNSPYCELEDGSDLPQCYWHDGAGDGSEPPYTDIVYMPDGYGYQAHEDTMTVSVFARNPWL

SEQ ID NO: 683 - protein, 36 aa, unidentified
  REGION 1..36: note = Eggerthellaceae bacterium
MARAVIRGDYGNGEERRRRLGSYYSIVQARVNEMLS

SEQ ID NO: 684 - protein, 374 aa, unidentified; identical to SEQ ID NO: 147
  REGION 1..374: note = Arthrobacter phage Makai

SEQ ID NO: 685 - protein, 374 aa, unidentified
  REGION 1..374: note = Arthrobacter phage Truckee
MTFSSLISGTIPHNNKYSSRQGVPVSRIIQHHFAGFSDGRLRSATEQASSHYVIYNDGSIWGLVPEEFRAWTSGSFEADAPAITYEVQNSSLQINGNDNDAGSWAVSPAAYNSIVRLTADIARRHGFGAVTPTNYQGHRQWYPTACPGGYLWARMDNTRSLANKALTGAVAPAATPATPPTKGKTVWQLADEVLAGHHGSGDARKASLGAQYDAVQAEVNRRLGAGTAAPKVKTISQLADEVIAGKHGTGAARQKSLGNQYAAVQNEINRRLGGGGVAPQGVNISALADRVLRGEFGSGDVRVKALGKNYAAVQAEVNRRLGGGKAAAAPKRVVNISALADAVIRGEYGSGEDRKRRLGANYAAVQAEVNRRYS

SEQ ID NO: 686 - protein, 36 aa, Bifidobacterium bifidum
MARAVIRGDYGNGNERKRRLGSYYSIVQTRVNEMLS

SEQ ID NO: 687 - protein, 37 aa, unidentified
  REGION 1..37: note = Adlercreutzia sp. ZJ304
MLARAVINGDYGNGKERKRRLGSSYASVQRRVNELLA

SEQ ID NO: 688 - protein, 36 aa, unidentified
  source 1..36: note = Parolsenella sp.
MARAVIRGDYGNGAERKRRLGSLYDAVRARVNEILS

SEQ ID NO: 689 - protein, 369 aa, unidentified; identical to SEQ ID NO: 145
  REGION 1..369: note = Arthrobacter phage Gordon

SEQ ID NO: 690 - protein, 242 aa, Collinsella tanakaei
MREMFVGSGLFSWKPVSFIASRGDIYLDEEHHTAMCIRNDGTADLLGEFSISETGGIDGEPGDQTGRESWVHDYYSGSWDGILHYNGKADVGSASTPTGSGAPSGDVSELAARVIAGDFGNGDARRAELGSRYDEVQAEVNRILSGGSSSSSYDVDALARRVIAGEFGNGDARKQALGSKYSAVQKRVNEILGASGESSTSMDVDAMARAVIRGDYGNGEERKRRLGSYYSIVQRRVNEMLS

SEQ ID NO: 691 - protein, 298 aa, unidentified
  REGION 1..298: note = Caudoviricetes sp.
MNGIDISGHQQGIPVGEISADFVICKATQATGYISPDFKRQMEEAIASGKRVGAYHYAGGGNPGREAQHFLNVVKPYIGKAILCLDWERTTNASFGSGNDGAWTRRFLDYVKAATGVTGFLYISAGYRGWHTETLRRYRFWAAQYPDDKYTPIRDYLSNPWKDDDYTCDIHQYAASLYLPGWDHRLDADKAYITPEEWDALAAGETPDEDAPTVDELAQEVLNGKWGNGQARKDALEAAGYDYAAVQDRVNVLLADEEITALAQAVIRGDYGNGEERKRRLGVKYDAVQKRVNKILGF

SEQ ID NO: 692 - protein, 333 aa, unidentified; identical to SEQ ID NO: 144
  REGION 1..333: note = Caudoviricetes sp.

SEQ ID NO: 693 - protein, 300 aa, unidentified
  REGION 1..300: note = Caudoviricetes sp.
MNGIDIASHQSGINLMIVPGDFVIVKATQSTGYVNPDFKRAFEQGLASGKRMGIYHYAGGGNPQREARHFLNIARPYIGKAILCLDWERTQNASFGYGDDAWCKSFLDYVRAETGVTGFLYISAGYIPIFKQTLLTYNLWAAQYPDYNPVRGYDETPWNEHKDYECDIRQYTSMLFLPGWNHRLDGDKAYITGEEWDKLCGASAEEPDDEPEHLDIDDLAQEVLNGRWGNGAERRELLEAAGYDYDAVQARVNALLADDDISALAQAVIRGDYGNGEERKRRLGAKYDAVQKRVNKILGF

SEQ ID NO: 694 - protein, 367 aa, unidentified
  REGION 1..367: note = Caudoviricetes sp.
MDKRRASKRRIHAIRRGEGMIHMSMRGFDISEWQKDIDINAVDYDFVICKATQGTSYVNGYCDINIQKAKQAGKPWGFYHFMWDCDPVEQADYFYANCKNYFGEGIPILDYEDGGRIGSDGAKRFLDRIYELTGVRCLFYTYRNVVQSPHEDEDWGAIARNHALWVAQYANDEQTGYQDSPWLPGGEFGAWKTIVMHQYTSHGRLDGYGGNLDLDIAYMDADAWARYTKPGTSNVQPAASDAPSGSAADIATDVMRGKYGNGDERKAKLGGRFDEVQSLINRAATASADDLASDVLNGLFGNGDTRRAILGSRYDEVQTIVNGKANGVDIDALARAVIRGEYGDGETRKAKLGANYDAVQKRVNELL

SEQ ID NO: 695 - protein, 547 aa, Olsenella sp.
MGLNGIDISSWQDDLVVSAMATCDFVIVKATGGAGYANECFRRHADETLAAGKLLGCYHYARDRGYEGSAEAEADWFISAFEPYIGKAIPFLDWEADALNLGPSWAKKWLDRVKSKTGVTPGIYTSKSVLFSYDWSAIAKTYPLWVAQYPNYEDTGFLDEPWTDGWDFGAWDSPLIFQYTGTGRIPGYGGHLDLDLFYGTKDDWRRLCAVAGASAVTEEVKTVSISRANVAAQIMEHLCTCPLHGYSQPGRHGTSGYCNVNTDAGAIKVTKGDRDCSSAVCEAWELALAGSPYDGLITRYNWTGGMREMFVGSGLFSWKPMSFNAQRGDIYLDESSHTAMCVRNDGTADLLAEFSISETGGIDGEPGDQTGRESWVHDYYSGHWDGILHYNGKADVGSASTPTGSGAPSGDVSELAARVIAGDFGNGDARRAALGSRYDEVQAEVNRILSGGSSSGSYDVDALARRVIAGEFGNGDERKRRLGDKYSAVQKRVNDILGASGASTTSMDVDAMARAVIRGDYGNGEERRRRLGSYYSIVQARVNEMLS

SEQ ID NO: 696 - protein, 547 aa, unidentified
  REGION 1..547: note = Atopobiaceae bacterium
MGLNGIDISSWQNDLVVSAMTTCDFVIVKATGGAGYTNECFKRHADQTLAAGKLLGCYHYARDRGYEGSAEAEADHFISAFKTYIGKAIPFLDWEADALNLGPSWAKRWLDRVREKTGVAPGIYTSKSVLFSYDWSSAAKTYPLWVAQYPNYEETGFLSEPWTDGWDFGAWKGPLIFQYTGTGRIPGYGGHLDLDLFYGTKDDWRGRCAVVGVSAGTREADTVSISRANVAAQIMEHLCTCSEHGYSQPGRHGTSGHCNVKTDAGTIKVTKGDRDCSSAVCEAWELALAGSPYDGLITRYNWTGGMREMFVGSGLFSWKPMSFNATRGDIYLDEEHHTAMCIRNDGMADLLGEFSISETGGIDGEPGDQTGRESWIHDYYSGSWDGILHYNGKADVGSASTPTGSGAPSGDVSELAARVIAGDFGNGDARRAALGSRYDEVQAEVNRILSGGSSSSSYDVDALARRVIAGEFGNGDERKRRLGDRYSAVQRRVNEILGAVGTTSTSMDVDAMARAVIRGDYGNGEERKRRLGSYYSIVQRRVNEMLS

SEQ ID NO: 697 - protein, 547 aa, unidentified
  REGION 1..547: note = Atopobiaceae bacterium
MGLNGIDISSWQDDLVVSAMATCDFVIVKATGGAGYANECFRRHADETLAAGKLLGCYHYARDRGYEGSAEAEADWFISAFEPYIGKAIPFLDWEADALNLGPSWAKKWLDRVKSKTGVTPGIYTSKSVLFSYDWSAIAKTYPLWVAQYPNYEDTGFLDEPWTDGWDFGAWDSPLIFQYTGTGRIPGYGGHLDLDLFYGTKDDWRRLCAVACASAVTEEVKTVSISRANVAAQIMEHLCTCPLHGYSQPGRHGTSGYCNVNTDAGAIKVTKGNRDCSSAVCEAWELALAGSPYDGLITRYNWTGGMREMFVGSGLFSWKPMSFNAQRGDIYLDESSHTAMCVRNDGTADLLAEFSISETGGIDGEPGDQTGRESWVHDYYSGHWDGILHYNGKADVGSASTPTGSGAPSGDVSELAARVIAGDFGNGDARRAALGSRYDEVQAEVNRILSGSSSSGSYDVDALARRVIAGEFGNGDERKRRLGDKYSAVQKRVNDILGASGASTTSMDVDAMARAVIRGDYGNGEERRRRLGSYYSIVQARVNEMLS

SEQ ID NO: 698 - protein, 547 aa, unidentified
  REGION 1..547: note = Atopobiaceae bacterium
MGLNGIDISSWQEDLVVSAMGTCDFVIVKATGGAGYKNECFRRHADETLAAGKLLGCYHYARDRGYEGSAVAEADHFIAAFKPYVSKAIPFLDWEADALSLGPSWAKRWLDRVKAKTGVTPGIYTSKSVLFSYDWAAVAKTYPLWVAQYPNYEETGFLSEPWTDGWDFGAWSSPLIFQYTSTGRIPGYGGHLDLDLFYGTKDDWRGRCAIVGASAGTREADTMSISRANVAAQIMEHLCTCSEHGYSQPGRHGTSGHCNVKTDAGMIKVTKGDRDCSSAVCEAWELALAGSPYDGLITRYNWTGGMREMFVGSGLFSWKPMSFNATRGDIYLDEEHHTAMCIRNDGMADLLGEFSISETGGIDGEPGDQTGRESWIHDYYSGSWDGILHYNGKADVGSASTPTGSGAPSGDTSELAARVIAGDFGNGDARRAALGSRYDEVQAEVNRILSGGSSSSSYDVDALARRVIAGEFGNGDARKQALGSKYSAVQKRVNEILGASGTTMTSVDVDAMARAVIRGDYGNGEERKRRLGSYYSIVQRRVNEMLS

SEQ ID NO: 699 - protein, 327 aa, unidentified
  REGION 1..327: note = Actinomycetota bacterium
MSFSSLANMGARIPHGGRFSQRTSKITGFTIHHQAGVDAHGEASNPRREVSANYWIANDGTIIPNIDEDHRAWTTGAVGYPAGAQSDMRNITVEVSNSPEGVRSGSWAISDAAFNSLVALLADCANRHGFPIRRGTGTGVAVHQDFVPTSCPGPYIMGNLGTIIARAAAGGGSAGAPTQQAPAATGGKSVAQLADEVQAGVYGNGDQRRQALGGMYDAVQAEVNRRLYGGQAPQVHVNIDQLAHAVLRGEYGNGDERMRRLGNNYAAVQARVNQLLNITPAPAGPDIEGMARAAIRGDYGNGAQRQAALGANYAAVQARVNQILGIG

SEQ ID NO: 700 - protein, 310 aa, unidentified
  REGION 1..310: note = Ancrocorticia sp.
MSYQQSFTPAHPSNYTKGRGGKRITTIVIHHWDDPARNPQLSGVIATFQNPGRGASAHFVVEAGRVVQMVDLANTAWHAGNWPINQCSIGIECNPRCSDADKATIGELIRNLQATYGPLKIIGHKDASSTACPGRYYPPASVLGPYITGGGSPAAPAPSVGGDIETLAQAVIRGEYGNGEDRKARLGSQYSAVQARVNEILAGRASQPAPTAPATPAPAPDIDALADAVIRGNYGNGEDRKSRLGHLYEAVQARVNAKLSGSAPAAAPGPNLEALADAVIRGEYGNGAERRNRLGHLYDAVQAIVNRKLS

SEQ ID NO: 701 - protein, 278 aa, Bifidobacterium pseudolongum
MKNWDKLEADINLILDKHFTGGRDGRKVDKVVLHHNGGNLTGQGCYTVWQTRQASAHYQVDSNGVISQHVWDSDTAWHAGNWDANTTSIGIEHADISTNPWRISDACLDNGAHLTAAVCKAYGLGRPAYGRNVFYHKDFSATECPASIAGSQRDAYMRRAQEWYDKMTGNKPAASAPAKPSTPAKKSVETIAREVIAGQWGNGNDRMTRLKNAGYDANTVQTRVNQLLGASTPSPNVDLNALADAVIRGEYGNGAERQRRLGANYAAVQAIVNRKMGW

SEQ ID NO: 702 - protein, 118 aa, Arcanobacterium sp.; identical to SEQ ID NO: 139

SEQ ID NO: 703 - protein, 41 aa, unidentified
  REGION 1..41: note = Gordonibacter sp. An230
MDVDAMARAVIRGDYGNGEERKRRLGSYYSIVQRRVNEMLS

SEQ ID NO: 704 - protein, 348 aa, unidentified
  REGION 1..348: note = Collinsella sp. TF10-11AT
MMHMSMRGFDISDWQKDIDINAVDYDFVICKATQGTSYVNGYCDINIQKAKQAGKPWGFYHFMCDCDPVEQADYFYANCKNYFGEGIPILDYEDGGRIGSDGAKRFLDRIYELTGVRCLFYTYRNVVQSPHDDEDWGAIAQNHALWVAQCANDNVTGYQDSPWLPSGGFGAWKTCVMHQYTSHGRIDGYGGNLDLDIAFMDAAAWARYAKPSTCNAQPVESIEPSGSAADIAADVMRGKYGDGEERKAKLGARFEEVQNLINRAAIASADELASDVLNGLFGNGETRRAILGNRYDEVQAVVNGKANAVDIDALARAVIRGEYGDGEERKAKLGANYDAVQKRVNELI

SEQ ID NO: 705 - protein, 543 aa, Olsenella profusa
MGLNGIDISSWQDDLVVSAMGTCDFVIVKATGGAGYSNECFRRHADETLAAGKLLGCYHYARDRGYEGSAEAEADHFIAAFRPYVGKAIPFLDWEADALSLGPSWAKRWLDRVKAKTGVTPGIYTSKSVLFSYDWAAVAKTYPLWVAQYPNYEETGFLSEPWTDGWDFGAWSSPLIFQYTGTGRIPGYGGHLDLDLFYGTKDDWRRLCAIAGASAGTGEVKEVSISRANVAAQIMEHLCNCAEHGYSQPGRHGTSGHCSVKTDAGVVKVTKGDRDCSSAVCEAWELALAGTTYDGLITRYNWTGGMREMFVGSGLFSWQAVTANAQRGDIYLDEENHTAMALGGGKIGHFTGSETGGIDGAPGDQTGRESRIQDYYRGSWDGVLHYNGKADVGGASTPTGSGAPSGDVSELAARVIAGEFGNGDARKAALGDRYDEVQAEVNRILLGGSSGGSYDIDALARRVIAGEFGNGDERKRRLGDKYSAVQQRVNEILGATGASSTSMDVDAMARAVIRGDYGNGEERKRRLGSYYSIVQRRVNEMLS

SEQ ID NO: 706 - protein, 255 aa, unidentified
  REGION 1..255: note = Boudabousia
MSYTIDHSHDATAFTTGRQGHRIKYIVVHHWDDPAKHPTFEGTIRWFERGGNNTSAHYVAEAGRVAQLVADGDTAYHAGNWVKNLESIGIECNPRCSDADKATVAELIRDLQAKHGPLTILGHKDCTSTDCPGRYYPPTRVLAPWLSGGSGNAKPATTATAPSGDLNALADAVLRGDYGNGEERKRRLGSKYSAVQAIVNQRLGYGTAPASTGPNLNALADAVIRGDYGNGDERKRRLGANYKAVQALVNRKLGY

SEQ ID NO: 707 - protein, 547 aa, unidentified
  REGION 1..547: note = Olsenella urininfantis
MGLNGIDISSWQDDLVVSVMGTCDFVIVKATGGADYSNECFRRHADETLAADKLLGCYHYAHDCGYEGSAEAEADHFIAEFRPYVGKAIPFLDWEADALNLGPVWAKKWLDRVKAKTGVTPGIYTSKSVLFSYDWSGVAKTYPLWVAQYPNYEETGFLSEPWTDGWDFGAWDSPLIFQYTGTGRIPGYGGHLDLDLFYGTRDDWRRLCAVAGASAGTGEVKEVAISRANVAAQIMEHLCTCPLHGYSQPGRHGTSGHCSVQTDAGVVKVTKGDRDCSSAVCEAWELALAGTQYDGLITRYNWTGGMREMFVGSGLFSWKPMSFNAKRGDIYLDESTHTAMCVRNDGTADLLAEFSISETGSIDGEPGDQTGRESWVHDYYSGHWDGILHYNGKADGTAAPGESGSGAPSSDVSELAARVIAGDFGNGDARVAALGERYDEVQAEVNRILSGGSSGGSYDVDALARRVIAGEFGNSDERRRRLGDKYSAVQKRVNEILGASGTSSTSMDVDAMARAVIRGDYGNGEERRRRLGSYYSVVQARVNEMLS

SEQ ID NO: 708 - protein, 297 aa, unidentified
  REGION 1..297: note = Olsenella sp. oral taxon 807
MNALDGVAGRAFSYGVGIGGAHWRRGDAGWRGGVELAMAARWSGRQCADYFAGTTRQASSNYCIGVDGDVVMSMDEDDRAWTSSSAWNDRRAITIECGNIDNSTGEMSQKTWDTLVGLCADICTRYGFRLNYTGDRNGSLTEHRMFASTACLGARLHARMGKLASEVNARLDGGSTKSDSKSGSSDVYLVKVTCDALNIRKGPGTGYAVVGCIRSRGTYTIVGTSGNWGRLKSGAGWICLDYTSRAGSAKASSAKAADIDAMARAVIRGDYGSGEERRCRLGEKYAAVQRRVNELLK

SEQ ID NO: 709 - protein, 278 aa, Bifidobacterium pseudolongum
MKNWDKLEADINLILDKHFTGGRDGRKIDKVVLHHNGGNLTGQGCYNVWQTRQASAHYQVDSNGVISQHVWDSDTAWHAGNWEANTTSIGIEHADISTNPWRIADACLDNGAHLTAAVCKFYGLGRPEYGRNVFYHKDFSATECPASIAGSQRDAYMRRAQEWYDKMTGSKPAASAPAKPSTPAKKSVETVAREVIAGQWGNGNDRMTRLKNAGYDANAVQTRVNQLLGASTPSPNVDLNALADAVIRGEYGNGAERQRRLGANYAAVQAIVNRKMGW

SEQ ID NO: 710 - protein, 258 aa, Trueperella pyogenes
MSNTYTLNHRQAACFTPGRGGNRITTIVIHHWDDPAKNPSFNGTVDWFVTGRGRNSAHYVVEAGRVTRMVAESDTAWHAGNWPVNQTSIGIECNPRASEADKQTIAALIRDIQSRHGKLRIIGHKDASSTACPGRYYPPTVTLAPYLGSNGGVPTAVKPPAPTAAGGSVDELARAVIAGKYGNGEERRRRLGNRYGEVQARVNELIAGKAPAPSAPNLDALANAVLRGEYGNGEERRRRLGSLYQPVQDLVNRKLGIR

SEQ ID NO: 711 - protein, 278 aa, Bifidobacterium pseudolongum
MKNWDKLEADINLILDKHFTGGRDGRKIDKVVLHHNGGNLTGQGCYNVWQTRQASAHYQVDSNGVISQHVWDSDTAWHAGNWEANTTSIGIEHADISTNPWRISDACLDNGAHLTAAVCKFYGLGRPEYGRNVFYHKDFSATECPASIAGSQRDAYMRRAQEWYDKMTGSKPAASAPAKPSTPAKKSVETVAREVIAGQWGNGNDRMTRLKNAGYDANAVQTRVNQLLGASTPSPNVDLNALADAVIRGEYGNGAERQRRLGANYAAVQAIVNRKMGW

SEQ ID NO: 712 - protein, 547 aa, unidentified
  REGION 1..547: note = Gordonibacter sp. An230
MGLNGIDISSWQDDLVVSAMGSCDFVIVKATGGAGYSNECFRRHADETLAAGKLLGCYHYARDHGYEGSAESEADHFISAFKPYTGKAIPFLDWEADALNLGPSWAKTWLERVKAKTGVTPGIYTSKSVLFSYDWSSVAKTYPLWVAQYPNYEETGFLSEPWTDGWDFGAWKDPLIFQYTGTGRIPGYGGHLDLDLFYGTKDDWRGLCAVAGASAGTKEVKEVAISRANVAAQIMEHLCTCAEHGYSQPGRHGTSGHCNVKTDAGTIKVTKGDRDCSSAVCEAWELALAGSPYDGLITRYNWTGGMREMFVGSGLFSWKPMSFNASRGDIYLEEEHHTAMCIRNDGTADLLGEFSISETGGIDGEPGDQTGRESWIHDYYPGSWDGILHYNGKADTGGASTPTGSGAPSGDVSELAARVIAGDFGNGDARRAALGSRYDEVQAEVNRILSGGSSSSSYDVDALARRVIAGEFENGDERKRRLGDRYSAVQKRVNEILGASGAGTTSMDVDAMARAVIRGDYGNGEERKRRLGSYYSIVQRRVNEMLS

SEQ ID NO: 713 - protein, 345 aa, unidentified
  REGION 1..345: note = Collinsella sp. TF10-11AT
MSMRGFDISDWQKDIDINAVDYDFVICKATQGTSYVNGYCDINIQKAKQAGKPWGFYHFMCDCDPVEQADYFYANCKNYFGEGIPILDYEDGGRIGSDGAKRFLDRIYELTGVRCLFYTYRNVVQSPHDDEDWGAIAQNHALWVAQCANDNVTGYQDSPWLPSGGFGAWKTCVMHQYTSHGRIDGYGGNLDLDIAFMDAAAWARYAKPSTCNAQPVESIEPSGSAADIAADVMRGKYGDGEERKAKLGARFEEVQNLINRAAIASADELASDVLNGLFGNGETRRAILGNRYDEVQAVVNGKANAVDIDALARAVIRGEYGDGEERKAKLGANYDAVQKRVNELI

SEQ ID NO: 714 - protein, 547 aa, unidentified
  REGION 1..547: note = Xiamenia xianingshaonis
MGINGIDISSWQEDLVVSKMTTCDFVIVKATGGAGYSNECFKKHADQTLAAGKLLGCYHYARDRGYEGSAEAEADHFIKTFKPYIGKAIPFLDWEADALSLGVAWAKAWLDRVKSKTNVTPGIYTSKSVLFSYDWSSVAKAYPLWVAQYPNYKETGFKSEPWTDGWDFGAWKDPLLFQYTGTGRITGYSGHLDLDLFYGTKDDWRRLCAVAGASAGTKEAKTVSISRANVAAQIMEHLCTCPEHGYSQPGRHGTNGHCNVQTDAGTIKVTKGDRDCSSAVCEAWELALAGSPYDGLITRYNWTGGMREMFVGSGLFSWKPMSFNASRGDIYLDESSHTAMCIRNDGTADLLGEFSISETGGIDGEPGDQTGRESRVHDYYSGHWDGILHYNGKADTGGASTPTDSGAPSGDVSELAARVIAGDFGNGDARRAALGSRYDEVQAEVNRILSGGSSSGSYDVDALARRVIAGEFGNGDERKRRLGDKYSAVQNRVNEILGASGASSTSMDIDAMARAVIQGDYGNGDERRRRLGSYYSIVQARVNEMLS

SEQ ID NO: 715 - protein, 271 aa, Mobiluncus curtisii
MKNWNTLDADINLLLDKHYSKGRQGHQIDKIILHHNAGNLSVRGCFDTWQTRQASAHYQVESTGIIGQLVWDGDTAWHAGNWVANTTSIGIEHADASTHPYRISDACLENGAHLVAALCHYYKLGRPCWGKNVFGHRDFSATECPASIAGSQHETYMARAGYWYDQISGNKPNPPSAGKPDIEALANAVIRGEYGNGDQRRARLGGLYDPVQARVNEILGLKSKPAGKSIETLAREVIRGDWGNGQERYNRLTNAGYNYAQVQNRVNQILS

SEQ ID NO: 716 - protein, 271 aa, unidentified
  REGION 1..271: note = Actinomycetes
MKNWNTLEADLNLLMNKHFTKGRQGRSINKIILHHNDGNLSIQGCWNVWQTRPASAHYQVETSGRIGQLVWDRDTAWHAGNWDANCTSIGIEHADASTHPYRISDACLENGAHLVAALCHYYKLGRPVWGKNVFGHRDFSATECPASIAGSQHATYMSRAGYWYDQMGGNKPNPPSAGKPDIEALANAVIRGEYGNGDQRRARLGGLYDPVQARVNEILGLKSKPAGKSIETLAREVIRGDWGNGKERYNRLTNAGYSYQQVQNRVNQILS

SEQ ID NO: 717 - protein, 310 aa, unidentified
  REGION 1..310: note = Actinomyces faecalis
MSYQQSFTPAHPSNYTKGRGGKRITTIVIHHWDDPAKNPQLSGVITTFQNPGRGASAHFVVEAGRVVQMVDLANTAWHAGNWPINQCSIGIECNPRCSDADKATIGELIRNLQATYGPLKIIGHKDASSTACPGRYYPPAQVLAPYITGGGSPAAPAPSVGGDIEALAQAVIRGEYGNGEDRKARLGSQYSAVQARVNEILAGRASQPAPSAPASPAPAPDIEALADAVIRGDYGNGADRKARLGHLYDAVQARVNAKLSGSAPAPAPGPNLESLADVVIRGEYGNGAERRNRLGHLYDAVQAIVNRKLS

SEQ ID NO: 718 - protein, 324 aa, unidentified
  REGION 1..324: note = Corynebacterium belfantii
MRPKNQKENCQPNPQQTQQSFTPAHPSNYTRGRGGKRITTIVIHHWDDPARNPQLSGVIATFQNPGRGASAHFVVEAGRVVQMVDLANTAWHAGNWPINQCSIGIECNPRCSDADKATIGELIRNLQATYGPLKIIGHKDASSTACPGRYYPPAQVLAPYINGGGSPAAPAPSVGGDIEALAQAVIRGEYGNGEDRKARLGHLYEAVQARVNEILAGRASKPAASAPASPAPAPDIEALADAVIRGDYGNGEGRKARLGHLYEAVQARVNAKLSGSAPAPAPGPNLEALADAVIRGEYGNGAERHNRLGHLYDAVQAIVNRKLS

SEQ ID NO: 719 - protein, 255 aa, unidentified
  REGION 1..255: note = Schaalia sp. lx-260
MSYTIDHSHDATAFTRGRQGHRIKYIVVHHWDDPAKHPTFEGTIRWFERGGNNTSAHYVAEAGRVAQLIADGNTAYHAGNWTKNLESIGIECNPRCNEADKATVAELIRDLQAKHGPLTILGHKDCSSTDCPGRYYPPTTVLAPWLGGGGGNAKPATTASAPSGDLNALADAVLRGDYGNGDERRRRLGSKYAAVQAIVNQRLGYGSTPAYSGPDLNALADAVIRGEFGNGEERKRRLGANYKAVQALVNKKLGY

SEQ ID NO: 720 - protein, 251 aa, unidentified; identical to SEQ ID NO: 137
  REGION 1..251: note = uncultured Varibaculum sp.

SEQ ID NO: 721 - protein, 345 aa, unidentified
  REGION 1..345: note = Senegalimassilia anaerobia
MSMRGFDISDWQKDIDINAVDYDFVICKATQGTSYVNGYCDINIQKAKQAGKPWGFYHFMWDCDPVEQADYFYANCKNYFGEGIPILDYEDGGRIGSDGAKRFLDRIYELTGVRCLFYTYRNVVQSPHDDEDWGAIARNHALWVAQYANDEQTGYQDSPWLPGGEFGAWKTIVMHQYTSHGRLDGYGGNLDLDIAYMDADAWARYAKPGTSNVQPAASDAPSGSAADIATDVMRGKYGNGDERKAKLGGRFDEVQSLINRAATASADDLASDVLNGLFGNGDTRRAILGSRYDEVQTIVNGKANGVDIDALARAVIRGEYGDGETRKAKLGANYDAVQKRVNELL

SEQ ID NO: 722 - protein, 548 aa, Olsenella profusa
MGLNGIDISGWQEDLVVSAMDTCDFVIVKATGGAGYANECFRRHADDTLSCGKLLGCYHYARDRGHEGSAEAEADHFINAFRPYVGKAIPFLDWEADALNLGVAWAKKWLDRVRDKTGVTPGIYTSKSVCLAYDWAAVAKAYPLWVAQYPNYEETGFLSEPWTDGWDFGAWSSPLVFQYTGTGRIPGYGGHLDLDLFYGTRDDWRRLCAVAGASAGTGEVKEVAISRANVAAQIMEHLCNCAEHGYSQPGRHGTSGHCNVSTDAGVVKVTKGDRDCSSAVCEAWELALAGTAYDGLITRYNWIGGMREMFVGSGLFSWKSMSLDAKRGDIYLDESTHTAMCIRNDGTVDLLGEFSISETGGIDGEPGDQTGRESWIHDYYSGHWDGVLHYNGKADVGGASVVCSFGAPSGDVSELAARVIAGEFGNGDARVAALGSRYDVVQAEVNRILSGGSSSGSYDVDALARRVIAGEFGNGDERKRCLGSKYSAVQDRVNEILGTSGTSSTSMDVDAMARAVIRGDYGNGDERKRRLGSYYSVVQRRVNEVLLS

SEQ ID NO: 723 - protein, 115 aa, unidentified
  REGION 1..115: note = Propionimicrobium lymphophilum
MARAIYWYDQISGNKPQASSAGKPDIEALANPVIRGKYGNGEERKGRLGANYAAVQQRVNEKLAGRTPAKPAGPNIDALADAVIRGEYGNDEERKRRLGNLYSVVQARVNAKLGY

SEQ ID NO: 724 - protein, 271 aa, Varibaculum cambriense
MNFETLTADENVIMNKHYTPGRNGHRIDKIVVHHNSGNLTTRGCWQVWQTRQASAHYQVEESGKIGQLVWDRDTAWHASNWAANQTSIGIEHANNNLNAQTISPATLESGAHLVAAICKKYGLGRPQWGKNVFPHQRFAATDCPGQIAHGQRSQYMNRACYWYDHMTGNHSAPALARAAAPNLEALADAVIRGEYGNGETRKRKLGANYSAVQAIVNRKLTGKPARAAAPNLEALADAVIRGEYGNGETRRRKLGANYSAVQAIVNRKLGA

SEQ ID NO: 725 - protein, 257 aa, Bifidobacterium scardovii; identical to SEQ ID NO: 141

SEQ ID NO: 726 - protein, 256 aa, unidentified
  REGION 1..256: note = Actinotignum urinale
MAYDYITQYNARSYTPGREGCAIDTIVVHHWDDPEKNPKFEGVLNWFCHSAPTSAHYVVEAGRVACLVSCADTAYHAGNWGMNLRSIGIECNPRCSEEDKATVGELIANLQATYGNLRVIGHKDVKSTSCPGRYYPPAQILAPYIKQGGGAVASQPAPVPSTGGTDINALADAVLRGEYGNGADRRARLGGLYDAVQAVVNQKLGATGNTRGAGVDINALADGVLKGLYGNGAERRQRLGVHYDAVQAEVNRRLGY

SEQ ID NO: 727 - protein, 258 aa, Trueperella pyogenes
MSFQLLTNRAAPCFTKGRGGNKIKYIVIHHWDDPAKKPSFDGVVSWFASGRGNNSAHYVVEAGKVARMVSETDTAWHAGNWAYNQQSIGIECNPRNTDADRRTIGELIDDIQRRHGKLTIIGHKDCSSTACPGSYYPPAKVLAPYIGTGSTPAPAPTPQPAPAPAGDTEALARAVIRGDYGNGEERKRRLGDKYAAVQARVNQILATGGTAKPAPAPDIEALANAVIRGDYGNGEERRRRLGTLYAKVQARVNQKLGY

SEQ ID NO: 728 - protein, 28 aa, unidentified
  REGION 1..28: note = Atopobiaceae bacterium
MDVDAMARAVIRGDYGNGEERKWRLGSY

SEQ ID NO: 729 - protein, 36 aa, Atopobium sp.
MARAVIRGDYGNGDERRRRLGSYYSIVHSRVNEMLS

SEQ ID NO: 730 - protein, 36 aa, Bifidobacterium bifidum
MARAVIRGDYGNGDERKRRLGSYYSIVQTRVNEMLS

SEQ ID NO: 731 - protein, 36 aa, unidentified
  REGION 1..36: note = uncultured Bifidobacterium sp.
MARAVIRGDYGNGDERKRRLGSYYLIVQTRVNEMLS

SEQ ID NO: 732 - protein, 36 aa, Rothia mucilaginosa
MADVVIRGEYGNGAERRDRLGHLYEAVQVIVNRKLI

SEQ ID NO: 733 - protein, 82 aa, unidentified
  REGION 1..82: note = uncultured Bifidobacterium sp.
MAGQWGNGDQRRQRLEAAGYDYQTIQTRVNQKLGQNTTTSVDLDALADAVIRGDYGNGDARKQALGSNYAAVQAIVNKKLGL

SEQ ID NO: 734 - protein, 223 aa, unidentified
  REGION 1..223: note = Cutibacterium avidum
MMKNWKTLEADVDLIMNKHYTKGRGGHRIDKVIIHHNAGNLSIRGCYDMWQTREASAHYQVQSDGRIGQFVWDSDTAWHAGNWNANTTSIGIEHADISSSPWKVSDACLANGAHLVAAICRYYKLGRPAWGTNVFGHKDFSSTECPASLAGSQHAAYVVRAQYWYDHITGIKPVPAKRKPAVNLDALADAVIRGDYGNGEECKRRLGGLYSQVQKRVNQKLGY

SEQ ID NO: 735 - protein, 270 aa, unidentified
  REGION 1..270: note = Caudoviricetes sp.
MNFETLTADVNLIMNKHYTKGRGGHKIDKILVHHNSGRLTTRGCWDTWQTRQASAHYQVEESGRIGQLVWDRDTAWHASNWRANQTSIGIEHANNDMKAWTISPATLEAGAHLVAALCKNYGLGRPEWLKNVFPHQYFANTDCPGQIAHSQRAQYMARAQAWYDTMTGHKTAKPAPAPRVDLEALASAVIAGKYGNGEARRRALGANYSAVQAIVNKRLTGKSKPAPRVDLEALATAVIRGDYGNGAERRRRLGANYAAVQAIVNKRLLG

SEQ ID NO: 736 - protein, 276 aa, unidentified
  REGION 1..276: note = Caudoviricetes sp.
MTEKQIRAQVVATAEAWLGAKTGSAQHKEIIKIYNAQRPLPRGTQMQENWAWCAVFVSAVALKLGYRDIMPTEMSCHQMMLLYKQLGRWIENDAYVPSAGDVIFYDWQDGTNYAATDNTGTPDHVGIVTSCDGITIRVIEGNVSNEVGTRVLVVNGRYIRGFGVPDFASKATEEEKPADKTDDLARKIVTEINDSGLDAAAVLAKVSALLGAKPAEPEKPAEAPAEPEKKTPTAAEIDAMARDVIRGKYGNGARRRALLGDNYDAVQKRVNEILRG

SEQ ID NO: 737 - protein, 59 aa, unidentified
  REGION 1..59: note = Bifidobacterium pullorum subsp. gallinarum
MQKRVNEILGASGASSTSMDVDEMARAVIRGDYGNGEERKRRLGSYYSIVQRRVNEMLS

SEQ ID NO: 738 - protein, 547 aa, Slackia equolifaciens
MGLNGIDISSWQDDLVVSAMTTCDFVIVKATGGAGYSNECFRRHADGTLAAGKLLGCYHYARDRGYEGTAEAEADWFISAFKPYIGKAIPFLDWEADALDLGPTWAKKWLDRVKAKTGVTPGIYTSKSVCFAYDWSSVAKTYPLWVAQYPNYEETGFLSEPWTDGWDFSAWDSPLIFQYTGTGRIPGYGGHLDLDLFYGTRDDWRRLCAVAGASAGTGEVKEVAISRANVAAQIMEHLCTCPLHGYSQPGRHGTSGHCNVQTDAGTIRVTKGDRDCSSAVCEAWELALAGTVYDGLITRYNWTGGMREMFVGSGLFSWKPMSFNAQRGDIYLDESSHTAMCIRNDGTADLLAEFSISETGGIDGEPGDQTGRESWVHDYYTGHWDGILHYNGKADVGSASTPTGSDAPSGDVSELAARVIAGDFGNGDARRAALGSRYDEVQAEVNRILSGGSSSGSYDVDALARRVIAGEFGNGDDRRRRLGDKYSAVQKRVNEILGASGASSTSMDVDAMARAAIRGDYGNGDERKRRLGSYYSIVQRRVNEMLS

SEQ ID NO: 739 - protein, 68 aa, Bifidobacterium bifidum
MDCPWPASLSSVVAIMPKRKSTCQRIWGRFNAMARAVIRGDYGNGNERKRRLGSYYSIVQTRVNEMLS

SEQ ID NO: 740 - protein, 221 aa, Actinomyces graevenitzii
MKNWNTLEADVDLIMNTHYTPGRNGRQIDKVIIHHNAGNLTIRGCYDVWQTCPASAHYQVQTDGTIGQLVWDRDTAWHAGNFAANTTSIGIEHADMTSDPWTVSEACLDNGAHLVAAVCKYYKLGRPVWGKNVFGHKDFSATACPASLAGSQHAAYMARALYWYDQMTGTALAPAPAPAANLETMADAVIRGEYGNGAERRNRLGHLYDAVQAIVNRKLGY

SEQ ID NO: 741 - protein, 208 aa, unidentified
  REGION 1..208: note = Atopobiaceae bacterium
MCIRNDGTADLLGEFSISETGGIDGEPGDQTGRESWIHDYYSGSWDGILHYNGKADTGGAPGGSGSGAPSGDVSELAERVIAGEFGNGDARRAALGERYDEVQAEVNRILLGGSSSGSYDVDALARRVIAGEFGNGDARRQALGSRYDAVQRRVNKILGAAGTARISVDVDAMARAVIRGDYGNGDERKRRLGSYYSIVQARVNELLS

SEQ ID NO: 742 - protein, 306 aa, unidentified
  REGION 1..306: note = Atopobiaceae bacterium
MHLLEHGYSQPGRHGTSGSCSVKTDAGTVKVTKGDRDCSSAVCEAWELALRSTAYDGLITRYNWTGGMREMFVGSGLFSWKPVSFNASRGDIYLDEESHTAMCIRNDGTADLLGEFSTSEIGGIDGEPGDQTGRESWVHDYYSGSWDGILHYNGKADGGVVDGGTDTPSGDVADLARRVIAGEFGNGDARKTALGSHYDEVQAEVNRILLGGESSGIDVDAMARRVIAGEFGNGDERKRRLGSNYDTVQQRVNEILGAAGASSTSIDVDAMARAVIRGDYGNGVERKRRLGSYYTIVQSRVNQMLS

SEQ ID NO: 743 - protein, 545 aa, unidentified
  REGION 1..545: note = Atopobiaceae bacterium
MGLNGIDISSWQDDLVVGNMATCDFVIVKATGGAGYKNECYERHANDTLAAGKLLGCYHYARDRGYEGSAEAEADHFIAAFGPYVGKAIPFLDWEADALGLGPSWAKRWLDRVREKTGVTPGIYTSKSVLFSYDWSSVAKTYPLWVAQYPNYEDTGFVSEPWTDGWDFGAWESPLIFQYTGTGRITGYGGHLDLDLFYGNKDDWRRLCAVAGASAGTEEVKTVSISRANVAAQIMEHLCTCPLHGYSQPGRHGTSGHCNVNTDAGTVRVTKGDRDCSSAVCEAWELALAGSPYDGLITRYNWTGGMREMFVGSGLFSWKPMSFNAQRGDIYLDESSHTAMCIRNDGTADLLAEFSISETGGIDGEPGDQTGRESWVHDYYTGHWDGILHYNGKADVGDAPGGSGSGAPSGDVSELAERVIAGEFGNGDARVAALGSRYDEVQAEVNRILLGGGSGIDVDAMARRVIAGEFGNGDERKRRLGDKYSAVQKRVNEILEAAGTTKTSVDVDAMARAVIRGDYGNGDERKRRLGSYYSIVQARVNEMLS

SEQ ID NO: 744 - protein, 306 aa, unidentified
  REGION 1..306: note = Atopobiaceae bacterium
MHLLEHGYSQPGRHGTSGSCSVKTDAGTVKVTKGDRDCSSAVCEAWELALRSTAYDGLITRYNWTGGMREMFVGSGLFSWKPVSFNASRGDIYLDEESHTAMCIRNDGTADLLGEFSTSEIGGIDGEPGDQTGRESWVHDYYSGSWDGILHYNGKADGGVVDGGTDTPSGDVADLARRVIAGEFGNGDARKIALGSHYDEVQAEVNRILLGGESSGIDVDAMARRVIAGEFGNGDERKRRLGSNYDTVQQRVNEILGAAGASSTSIDVDAMARAVIRGDYGNGVERKRRLGSYYTIVQSRVNQMLS

SEQ ID NO: 745 - protein, 103 aa, unidentified
  REGION 1..103: note = Atopobiaceae bacterium
MPKHRQAYSSDASSVKQTPRRGVCSEKARASSERCQCLGSKYSAVQKRVNEILGASGAGSTSMDVDAMARAVIRGDYGNGDERKRRLGSYYSIVQARVNEMLS

SEQ ID NO: 746 - protein, 81 aa, unidentified
  REGION 1..81: note = Atopobiaceae bacterium
MLAGKYGNGDARKAALGSLYETVQARVNEILGSGSAAAQTPDIEALALAVIRGEYGNGEERRSRLSSLYAAVQARLNDILS

SEQ ID NO: 747 - protein, 564 aa, unidentified
  REGION 1..564: note = Atopobiaceae bacterium
MPLVGVDIYDGEASIDLAATGADFVIIKATQGDWQQEHWRESVAKAQAGGILFGLYHFPEVDKGVDVEVSTFLSTVKDFIGQAPLFLDWENNEVTGQKNLDAGVGYAKKFLDEVKARTGVTPLIYTSKSVTNEYDWSPVSSEGIGLWGSQYLNKYYDGSVHDLLDAPEMRSGWGAFVAPVIYQYTGNGHINGFDGDLDLDVAYMSREDWLKAATCGKQGGSTMPSIQKFVARMRYWCDEANLGYDQSNREDFEVGGETDCSALVIHCLQEAGFDTGEATYTGNMSDELCARGWERVSNDGNPQFGDILLNDSHHVAVYVGGGLLSQASHGEPGHRVRGGQSGDQTDDETITKAYYDFPWSCYLRYTGATSDEGGSSTDGRSVDELAQAVINGEFGDGDSRRTALGDQYEAVQARVNEILNGGSSIPAETRSVDELAQAVINGEFGDGDSRRTALGDQYEAVQARVNEILGGGPSPSVSADIDQLAQDVIDGKYGNGDDRRNALGANYDAVQARVNELLNGGSSDDIDALAQDVIDGKYGNGDDRKAALGSNYDAVQARVNEILG

SEQ ID NO: 748 - protein, 310 aa, unidentified
  REGION 1..310: note = Atopobiaceae bacterium
MADVAEFIQCDARNYTPGRRGCGISNVVVHYASTGASAHDNLLYFSRSDAKASAHYFIDKDGTLRQSVREGDTAWHAGNWEVNLRSVGVEVVSAGEDFTEAQVATLASLVADLRARYGIGAGDVIRHYDVTGKLCPAPYVDAGKWAALHARICGGAAPATGGGASAPSGDVADLARRVIAGEFGNGDARRTALGDRYQEVQAEVNRMLGAESAPSAPAPAVDVDELARRTISGEFGNGDARRAALGTDYAAVQARVNEMLGCGGGSGDAVDVDSLAQAVINGDYGNGEERKRRLGANYAAVQMRVNEILS

SEQ ID NO: 749 - protein, 310 aa, unidentified
  REGION 1..310: note = Atopobiaceae bacterium
MADVAEFIQCDARNYTPGRRGCGISNVVVHYASTGASAHDNLLYFSRSDAKASAHYFIDKDGTLRQSVREGDTAWHAGNWDVNLRSVGVEVVSAGEDFTEAQVATLASLVADLRARYGIGAGDVIRHYDVTGKLCPAPYVDAGKWAALHARICGGAAPATGGGASAPSGDVADLARRVIAGEFGNGDARRTALGDRYQEVQAEVNRMLGAESAPSAPAPAVDVDELARRTISGEFGNGDARRAALGTDYAAVQARVNEMLGCGGGSGDAVDVDSLAQAVINGDYGNGEERKRRLGANYAAVQMRVNEILS

SEQ ID NO: 750 - protein, 131 aa, Arcanobacterium sp.
SSTACPGRYYPPAQVLAPYLGGNSGVPAAPKPPAASAPGGSVDELARAVLAGRYGNGDERKRRLGSRYAEVQRRVNELIAGKAPAPSSPNLDALANAVLRGEYGNGEERRRRLGNLYQSVQNLVNRKLGIR

SEQ ID NO: 751 - protein, 307 aa, unidentified
  REGION 1..307: note = Atopobiaceae bacterium
MAEFIQCDARNYTPGRRGCGISNVVVHYASTGASAHDNLLYFSRSDAKASAHYFIDKDGTLRQSVREGDTAWHAGNWDVNLRSVGVEVVSAGEDFTEAQVATLASLVADLRARYGIGAGDVIRHYDVTGKLCPAPYVDAGKWAALHARICGGAAPATGGGASAPSGDVADLARRVIAGEFGNGDARRTALGDRYQEVQAEVNRMLGAESAPSAPAPAVDVDELARRTISGEFGNGDARRAALGTDYAAVQARVNEMLGCGGGSGDAVDVDSLAQAVINGDYGNGEERKRRLGANYAAVQMRVNEILS

SEQ ID NO: 752 - protein, 547 aa, unidentified
  REGION 1..547: note = Coriobacteriaceae bacterium
MGLNGIDISSWQEDLVVSKMTTCDFIIVKATGGKGYKNDCFKGHADATLAAGKLLGCYHYARDRGYEGSAEEEADFFISAFKPYVGKAIPFLDWEADALSLGVSWAKKWLDRVRAKTDVTPGIYTSKSVCNEYDWSSVSKAYPLWVAQYPNYEHTGFKSEPWTDSSDFGAWASPLLFQYTGTGRITGYAGDLDLDLFYGTKDDWRRLCAVAGASAGTKEVKEVASSRANVAAQIMEHLCNCAEHGYSQPGRHGTSGHCSVKTDAGVVKVTKGDRDCSSAVCEAWELALAGSPYDGLITRYNWTGGMREMFVGSGLFSWKPMSFNATRGDIYLDEEHHTAMCIRNDGMADLLGEFSISETGGIDGEPGDQTGRESWVHDYYSGSWDGILHYNGKADVGSVSTPTGSGAPSGDVSELAARVIAGDFGNGDARVAALGSRYDEVQAEVNRILSGGSSSSSYDVDALARRVIAGEFGNGDARKQALGSKYSAVQKRVNEILGASGSSSTSMDVDAMARAVIRGDYGNGEERKRRLGSYYSVVQQRVNEMLS

SEQ ID NO: 753 - protein, 258 aa, Arcanobacterium sp.
MSHSYTLNHRQAACFTPGRGGNRITTIVIHHWDDPAKNPSFDGTVGWFVSGRGRNSAHYVVEAGRVTRLVAESDTAWHAGNWPVNQTSIGIECNPRASEADKQTVAALIRDIQSRHGRLRIIGHKDASSTACPGRYYPPAQVLAPYLGGNSGVPAAPKPPAASAPGGSVDELARAVLAGRYGNGDERKRRLGSRYAEVQRRVNELIAGKAPAPSSPNLDALANAVLRGEYGNGEERRRRLGNLYQPVQNLVNRKLGIR

SEQ ID NO: 754 - protein, 83 aa, Actinobaculum suis
MLAGRYGNGEERKRRLGARYAEVQKRVNELIAGKAPAPSSPNLDALANAVLRGEYGNGDERRRRLGHLYQPVQDLVNRKLGIR

SEQ ID NO: 755 - protein, 41 aa, unidentified
  REGION 1..41: note = Enorma massiliensis
MDVDAMARAAIRGDYGNGDERKRRLGSYYSIVQRRVNEMLS

SEQ ID NO: 756 - protein, 76 aa, unidentified
  REGION 1..76: note = Actinomyces weissii
MEEAAPVSEEPPAVEETPVVEEAPAVEEAPAAAETPDIDALADAVIRGDYGNGEEREAALGDLYEQVQARVDEKLS

SEQ ID NO: 757 - protein, 91 aa, Eggerthella sinensis; identical to SEQ ID NO: 134

SEQ ID NO: 758 - protein, 367 aa, unidentified
  REGION 1..367: note = Senegalimassilia faecalis
MDKRRASKRRIHAIRRGEGMIHMSMRGFDISDWQKDIDINAVDYDFVICKATQGTSYVNGYCDINIQKAKQAGKPWGFYHFMWDCDPVEQADYFYANCKNYFGEGIPILDYEDGGRIGSDGAKRFLDRIYELTGVRCLFYTYRNIVQSPHDDEDWGAIARNHALWVAQYANDEQTGYQDSPWLPGGEFGAWKTIVMHQYTSHGRLDGYGGNLDLDIAYMDADAWARYAKPGTSNVQPAAPDAPSGSAADIATDVMRGKYGNGDERKAKLGGRFDEVQSLINRAATASADDLASDVLNGLFGNGDTRRAILGSRYDEVQTIVNGKANGVDIDALARAVIRGEYGDGETRKAKLGANYDAVQKRANELL

SEQ ID NO: 759 - protein, 280 aa, unidentified
  REGION 1..280: note = Bifidobacterium sp. AGR2158
MKNWDTLEADLDLILDRHFTGGRDGCKIDKVILHHNGGNLSGEGCYRVWQTREASAHYQVDANGVITQIVWDGDTAWHAGNYQANCTSIGIEHADISTNPWKISDATLDNGAHLTAAVCKYYGLGRPQYGKNVFFHKDFSATECPASIAGSQRDAYMHRAQEWYDKMTGSKPSATAKPAAKPSAPAKKSVETVAREVIAGQWGNGDDRMNRLRAAGYDAQAVQNRVNALLGVSTPSANVDLNALADAVIRGDYGNGAERQRRLGANYAAVQAIVNRKMGW

SEQ ID NO: 760 - protein, 41 aa, Bifidobacterium pullorum
MDVDEMARAVIRGDYGNGEERKRRLGSYYSIVQRRVNEMLS

SEQ ID NO: 761 - protein, 191 aa, Actinobaculum suis
QTFSRPDTAWHAGNWPVNQTSIGIECNPRASEADKQTVAALIRDIQSRHGKLRIIGHKDASSTACPGRYYPPAQVLAPYLGGNGGVPAAVRPPAASAPGGSIDELARAVLAGRYGNGEERKRRLGARYAEVQKRVNELIAGKAPAPSSPNLDALANAVLRGEYGNGDERRRRLGHLYQPVQDLVNRKLGIR

SEQ ID NO: 762 - protein, 329 aa, Bifidobacterium adolescentis
MKNWDTLEADEDMILNTHYTPGRSGRKISKIVVHHNAGNLSIVGCYSVWQTREASAHYQVQADGRIGQLVWDSDTAWHAGNWEANLTSIGIEHADISTSPWKISDATLDNGAHLVAALCKHYGLGRPAWGVNVFPHSAFSSTACPASLYGSQKDAYMAKAQAWYDQMTGGKPAPAPSNPAPQATDLNALADAVIRGDYGNGDTRRARLGDKYDAVMAIVNRRYGITGGNSGNGGGNGGANIDDLARRAINGEFGNGEARKAALGANYAAVQARVNQMLGQGGGSAPSVDLNALADAVIRGDYGNGDQRRARLGANYAAVQALVNKKLGY

SEQ ID NO: 763 - protein, 145 aa, unidentified
  REGION 1..145: note = Collinsella sp. An307
MKSGAPSGDVSELAARVIAGDFGNGDARRAALGSRYDEVQAEDNRILSGGTSGGSCDVDALARRVIAGEFGNGDERKRRLGSKYSAVQNRVNEILGATGASSTSMDVDAMARAAIRGDYGNGDERKRRLGSYYSIVQRRVNEMLS

SEQ ID NO: 764 - protein, 280 aa, unidentified
  REGION 1..280: note = Bifidobacterium criceti
MKNWDTLEADLDLILDRHFTGGRNGCKIDKVILHHNGGNLSGEGCYQVWQTREASAHYQVDANGGVTQLVWDSDTAWHAGNYQANCTSIGIEHADISTNPWQIGDATLDNGAHLTAAVCKFYGLGRPQYGKNVFFHKDFSPTECPASIAGSQRDAYMRRAQEWYDKMTGNKPAAPAKPAAKPSTPAKKSTETVAREVIAGQWGNGDDRMNRLRKAGYDAAAVQNRVNALLGASTPSPNVDLNALADAVIRGDYGNGAERQRRLGSNYAAVQAIVNRRMGW

SEQ ID NO: 765 - protein, 261 aa, unidentified
  REGION 1..261: note = Actinomyces minihominis
MPYQLITNRTAPCHTKGRGGNKIKYIVIHHWDDPAKKPSFDGVVNWFATGRGNNSAHYVVEAGKAARMVSESDTAWHAGNWAYNQQSIGIECNPRNTDADRKTIGELIDDIQKRHGKLAILGHKDCSSTTCPGNYYPPAKVLAPYIGKTSGSGAKPAAPSPAPAPAPAPSGSVDALARAVINGQYGNGEERKKRLGSNYAAVQARVNQILGGTSASKPAASKPAASKPAAVNIEALANAVIRGDYGNGEERKRRLGANYAA

SEQ ID NO: 766 - protein, 280 aa, Bifidobacterium choerinum
MKNWDKLEADRDLILDKHFTGGRNGCKIDKVILHHNGGNLSGEGCYNVWQTREASAHYQVDANGVITQIVWDSDTAWHAGDYQANCTSIGIEHADISTNPWKISDATLDNGAHLTAAVCKYYGLGRPQYGKNVFFHKDFSPTECPASIAGSQRDAYMHRAQEWYDKMTGSKPSATAKPAAKPSAPAKKSVETVAREVIAGQWGNGDDRMARLKQAGYDAQAVQNRVNALLGVSTPSPNVDLNALADAVIRGDYGNGAERQRRLGANYAAVQAIVNRKMGW

SEQ ID NO: 767 - protein, 269 aa, unidentified
  REGION 1..269: note = uncultured Varibaculum sp.
MNFETLQADINLLMNKHYTKGRGGHKIDKILIHHNSGRLTTRGCWDTWQTRQASAHYQVEESGRIGQLVWDRDTAWHASNWRANQTSIGIEHANNDTKAWTISPATLEAGAHLVAALCKNYGLGRPEWLKNVFPHQYFANTDCPGQIAHSQRAAYMARAQAWYDAMTGHKPGPAPAPAVDLEALASAVIAGKYGNGEARRRALGANYAAVQAIVNKRLTGKSKPAPRVDLEALASAVIAGKYGNGQERRRRLGSNYAAVQAIVNKRLLG

SEQ ID NO: 768 - protein, 256 aa, unidentified
  REGION 1..256: note = Actinotignum urinale
MAYDYITQYDARAFTPGHEGRSIDTIVVHHWDDPEKNPRFEGVLNWFCHSAPTSAHYVVEAGRVACLVSCADTAYHAGNWGMNLRSIGIECNPRASEEDKATVGELIANLQATYGNLRIIGHKDVKSTGCPGRYYPPTQILAPYIKQGGGAVASQPTPAPSTGGTDINALANAVLRGEYGNGADRRARLGGLYDAVQAVVNQKLGATGNTRGAGVDINALADGVLKGLYGNGAERRQRLGVHYDAVQAEVNRRLGY

SEQ ID NO: 769 - protein, 258 aa, Trueperella pyogenes
MSNTFTLNHRQAACFTPGRGGNHITTIVIHHWDDPAKNPSFNGTVGWFVSGRGRNSAHYVVEAGRVTRMVAESDTAWHAGNWPVNQTSIGIECNPRASEADKQTIAALIRDIQSRHGRLRIIGHKDASSTACPGRYYPPAQVLAPYLGGNGGVPAAVRPPAASAPGGSIDELARAVLAGRYGNGEERKRRLGARYAEVQKRVNELIAGKAPAPSSPNLDALANAVLRGEYGNGAERKRRLGSLYQPVQDLVNRKLGIR

SEQ ID NO: 770 - protein, 345 aa, unidentified
  REGION 1..345: note = Senegalimassilia faecalis
MSMRGFDISDWQKDIDINAVDYDFVICKATQGTSYVNGYCDINIQKAKQAGKPWGFYHFMWDCDPVEQADYFYANCKNYFGEGIPILDYEDGGRIGSDGAKRFLDRIYELTGVRCLFYTYRNIVQSPHDDEDWGAIARNHALWVAQYANDEQTGYQDSPWLPGGEFGAWKTIVMHQYTSHGRLDGYGGNLDLDIAYMDADAWARYAKPGTSNVQPAAPDAPSGSAADIATDVMRGKYGNGDERKAKLGGRFDEVQSLINRAATASADDLASDVLNGLFGNGDTRRAILGSRYDEVQTIVNGKANGVDIDALARAVIRGEYGDGETRKAKLGANYDAVQKRANELL

SEQ ID NO: 771 - protein, 310 aa, unidentified
  REGION 1..310: note = Corynebacterium belfantii
MSYQQSFTPAHPSNYTRGRGGKRITTIVIHHWDDPARNPQLSGVIATFQNPGRGASAHFVVEAGRVVQMVDLANTAWHAGNWPINQCSIGIECNPRCSDADKATIGELIRNLQATYGPLKIIGHKDASSTACPGRYYPPAQVLAPYINGGGSPAAPAPSVGGDIEALAQAVIRGEYGNGEDRKARLGHLYEAVQARVNEILAGRASKPAASAPASPAPAPDIEALADAVIRGDYGNGEDRKARLGHLYEAVQARVNAKLSGSAPAPAPGPNLEALADTVIRGEYGNGAERRNRLGHLYDAVQAIVNRKLS

SEQ ID NO: 772 - protein, 79 aa, unidentified
  REGION 1..79: note = Enorma massiliensis
MSADLGQIQIQIHLGSKYSAVQNRVNEILGATGASSTSMDVDAMARAAIRGDYGNGDERKRRLGSYYSIVQRRVNEMLS

SEQ ID NO: 773 - protein, 323 aa, unidentified
  REGION 1..323: note = Adlercreutzia sp. ZJ242
MAISRANVAAQVMEHLCSCSEHGYSQPGRHGASSHCSVATDAGAVKVRRDDRDCSSAVCEAWELALAGSAYDGLITRYNRTGGMREMFTGSGLFSWQPMSFNASRGDAYLNESTHTAMCVRYDGVTDLLAEFSVSETGGVDGAPGDQTGRESRVRGYYSGRWDGILHYNGKADGGGSPSYPSPDGIDDLARRVIAGEFGNGDERRAALGSRYGEVQAEVNRILSGGPSSSGPSADVDALARRVIAGELGNGEACKAALGGNYAAVRARVNEILGAAGTTRTSADVDAMVRAVIRGEYGDGDERKRRLGSYYPVVQRRVNEMLA

SEQ ID NO: 774 - protein, 56 aa, Eggerthella sinensis
MNEILGCGPSASGAASNVDALAHAVINGDYGNGEARRERLGADYEAVQRRVNELLA

SEQ ID NO: 775 - protein, 222 aa, unidentified
  REGION 1..222: note = Cutibacterium avidum
MKNWKTLEADVDLIMNKHYTKGRGGHRIDKVIIHHNAGNLSIRGCYDMWQTREASAHYQVQSDGRIGQFVWDSDTAWHAGNWNANTTSIGIEHADISSSPWKVSDACLANGAHLVAAICRYYKLGRPAWGTNVFGHKDFSSTECPASLAGSQHAAYVVRAQYWYDHITGIKPVPAKRKPAVNLDALADAVIRGDYGNGEECKRRLGGLYSQVQKRVNQKLGY

SEQ ID NO: 776 - protein, 316 aa, unidentified
  REGION 1..316: note = Schaalia sp. lx-260
MSSYEEITAYTSPAYTSGRPYGISCIVLHHWGDPATHPTFEGVVSYLTRASASTSAHYVAEAGRVACIVDPDNRAWHAGDGIGVGSAGNDKGIGIECNPRASEADVATIAALVADLRAVYGDLPIKVHSDFVPTQCPGAYRDLVGLIDGLARGTASSGTIPPRPEALAPIYAGDSIDALARRALAGDFGNGDERRAALGDAYDAVQARVNQLCGLGGPSQPAGVDAVARDVIAGAYGNGQERYEALRAAGYDPDAVQARVNEILGAAPDPAPSAGPDIEALARAVIRGEFGNGDERRAALGDAYDAVQARVNQLLS

SEQ ID NO: 777 - protein, 327 aa, Bifidobacterium pseudocatenulatum
MKNWNTLEADENLILNTHYTPGRSGGSVKYVVVHHNAGNLTAQQIYNVWQTREASAHYQVAADGKISQHVWDSDTAWACGNWDANTNSISVEHADISTSPWTISDATLDNGAHLVAALCKYYKLGRPQWNVNVFPHSHFSGTQCPASIAGSQNAAYMAKAQYWYDKMCGANPSAPSTPSQPQQHATNLEALADAVIRGDYGNGDQRRNALGANYDAVMAIVNQRYGITGGNGGNAGTNIDDLARRAINGEFGNGDQRRAALGSNYDAVQARVNQMLGQGGGSAPSVDLNALADAVIRGDYGNGDQRRNALGANYDAVQALVNKKLGY

SEQ ID NO: 778 - protein, 258 aa, unidentified
  REGION 1..258: note = Corynebacterium sp. 76QC2CO
MSHSYTLNHRQAACFTPGRGGNRITTIVIHHWDDPAKNPSFNGTVDWFVTGRGRNSAHYVVEAGRVTRLVAESDTAWHAGNWPVNQRSIGIECNPRASEADKQTVAALIRDIQSRHGKLRIIGHKDASSTACPGRYYPPAQVLAPYLGGNSGVPAAPKPPAVSAPGGSVDELARAVLAGKYGNGEERKRRLGSRYAEVQRRVNELIAGKAPAPDSPNLDALANAVLRGEYGNGEERRRRLGHLYQPVQDLVNRKLGIR

SEQ ID NO: 779 - protein, 258 aa, unidentified
  REGION 1..258: note = unclassified Corynebacterium
MSNTYTLNHRQAACFTPGRGGNRITTIVIHHWDDPAKNPSFNGTVDWFVTGRGRNSAHYVVEAGRVTRMVAESDTAWHAGNWPVNQTSIGIECNPRASEADKQTVAALIRDIQSRHGKLRIIGHKDASSTACPGRYYPPAQVLAPYLGGNSGVPAAPKPPAVSAPGGSVDELARAVLAGKYGNGEERKRRLGSRYAEVQRRVNELIAGKAPAPDSPNLDALANAVLRGEYGNGEERRRRLGHLYQPVQDLVNRKLGIR

SEQ ID NO: 780 - protein, 279 aa, unidentified
  REGION 1..279: note = Candidatus Collinsella stercoripullorum
MTKGDRDCSSAVCEAWELALAGSPYDGLITRYNWTGGMREMFVGSGLFSWEPMSFNASRGDIYLDEENHTAMCIRNDGTADLLGEFSISETGGIDGEPGDQTGRESWVHDYYSGSWDGILHYNGKADVGGAPGGSGSGAPSGDVPELAARVIAGDFGNGDARRAALGSRYDEVQAEVNRILSGGTSGGSCDVDALARRIIAGEFGNGDERKRRLGSKYSAVQNRVNEILGATGASSTSMDVDAMARAAIRGDYGNGDERKRRLGSYYSIVQRRVNEMLS

SEQ ID NO: 781 - protein, 262 aa, unidentified
  REGION 1..262: note = Thermophilibacter mediterraneus
MAYSILFKQCGSDHMTRGRSRAIDRIVVHFTATLASARNNATYFARNEGQGASAHYFVDDITPEIYQSVAEGDTAWHAGDWQMNCRAIGIEVVSAGEDFSATEVEKLGWLVRKLMAKYGIGASGVIRHYDVTGKLCPAPYVAASKWAALRAAITGGAVAPSGGGAAAPDGTVADLAHRVIAGEFGNGEARRAALGSRYSEVQAEVNRILDGGSSATAQQAGPDVDTLARAVIRGDYGNGAERKRHLGSLYGAVQARVNEMLS

SEQ ID NO: 782 - protein, 547 aa, unidentified
  REGION 1..547: note = Thermophilibacter mediterraneus
MGLNGIEISSWQEDLVVSAMTTCDFVIVKATGGAGYTNECFRRHCDETLATGKLLGCYHYARDRGYEGSAEAEADHFIAAFKPYVGKAIPFLDWEADALNLGVAWAKKWPDRVRDKTGVTPGIYTSKSVLFSYDWSSVAKTYPLWVAQYPNYEETGFLSEPWTDGWDFGAWKDPLIFQYTGTGRIPGYGGHLDLDLFYGTKDDWRGRCAVVGASAGTREADTVSISRANVAAQIMEHLCSCPEHGYSQPGRHGTSGHCSVNTDSGTIKVTKGDRDCSSAVCEAWELALAGSPYDGLITRYNWTGGMREMFVGSGLFSWEPMSFNASRGDIYLDEENHTAMCIRNDGAADLLGEFSISETGGIDGEPGDQTGREGWVHDYYSGSWDGILHYNGKADMGGAPGGSGSGAPSGDVSELAARVIAGDFGNGDARRAALGSRYDEVQAEVNRILSGGTSGGSCDVDALARRIIAGEFGNGDERKRRLGSKYSAVQNRVNEILGATGASSTSMDVDAMARAAIRGDYGNGDERKRRLGSYYSIVQRRVNEMLS

SEQ ID NO: 783 - protein, 79 aa, unidentified
  REGION 1..79: note = Enorma massiliensis
MSTDLGQIQIQIHLGSKYSAVQNRVNEILGATGASSTSMDVDAMARAAIRGDYGNGDERKRRLGSYYSIVQRRVNEMLS

SEQ ID NO: 784 - protein, 270 aa, Varibaculum cambriense
MNFETLTADVNLIMNKHYTKGRGGHKIDKILVHHNSGRLTTRGCWDTWQTRQASAHYQVEESGRIGQLVWDRNTAWHASNWRANQTSIGIEHANNDMKAWTISPATLEAGAHLVAALCKAYGLGRPEWLKNVFPHQYFANTDCPGQIAHSQRAQYMARAQYWYDTMTGHKPAKPAPAPRVDLEALASAVIAGKYGNGEARRRALGANYSAVQAIVNKRLTGKSKPAPRVDLEALATAVIRGDYGNGQERRRRLGANYAAVQAIVNKRLLG

SEQ ID NO: 785 - protein, 75 aa, unidentified
  REGION 1..75: note = uncultured Rothia sp.
MTSWRAKIPSARGNKSACGRDSRHPATQKAPAPAADIEAMADVVIRGEYGNGAERRDRLGHLYEAVQVIVNRKLI

SEQ ID NO: 786 - protein, 77 aa, unidentified
  REGION 1..77: note = Enorma massiliensis
MSTDLGQIQIHLGSKYSAVQNRVNEILGATGASSTSMDVDAMARAAIRGDYGNGDERKRRLGSYYSIVQRRVNEMLS

SEQ ID NO: 787 - protein, 227 aa, Bifidobacterium catenulatum
MKNWNTLEADENLILNTHYTPGRSGGSVKYVVVHHNAGNLTAQQIYNVWQTREASAHYQVAADGKISQHVWDSDTAWACGNWDANTNSISVEHADISTSPWTISDATLDNGAHLVAALCKYYKLGRPQWNVNVFPHSHFSGTQCPASIAGSQNAAYMAKAQYWYDKMCGANPSAPSTPSQPQQHATNLEALADAVIRGDYGNGDQRRNALGANYDAVQALVNKKLGY

SEQ ID NO: 788 - protein, 254 aa, Arcanobacterium hippocoleae
MSYQLITAHNAVCYTKGRGGNKIRYIVIHHWDDPAKHPQFNGVINWFKNPRSKVSAHYVVEAGRAARMVSESDTAWHAGNWAYNQQSIGIECNPRCSEEDKRTVAELVNDIRARYGNLPLLGHKDIVSTGCPGRYYHPNTILGPYLGKNSGGGATSGKPSGSAPSGDVTALARAVIHGDYGNGEERKRRLGARYNEVQAEVNRLLGIASTSQPDLNALADAVIRGDYGNGQERRRRLGNLYTQVQALVNKKLGY

SEQ ID NO: 789 - protein, 99 aa, unidentified
  REGION 1..99: note = uncultured Bifidobacterium sp.
MPASTGGQSIDTIADQVIAGQWGNGDQRRQRLEAAGYDYQTIQTRVNQKLGQNTTTSVDLDALADAVIRGDYGNGDARKQALGSNYAAVQAIVNKKLGL

SEQ ID NO: 790 - protein, 258 aa, Trueperella pyogenes
MSNTYTLNHRQAACFTPGRGGNRITTIVIHHWDDPAKNPSFNGTVDWFVSGRGRNSAHYVVEAGRVTRLVAESDTAWHAGNWPVNQTSIGIECNPRASEADKQTVAALIRDIQSRHGKLRIIGHKDASSTACPGRYYPPTKVLAPYLGGNSGVPAAPKPPAASAPGGSVDELARAVLAGRYGNGDERKRRLGSRYAEVQRRVNELISGKAPAPAAPNLDALANAVLRGEYGNGDERRRRLGHLYQPVQDLVNRKLGIR

SEQ ID NO: 791 - protein, 184 aa, unidentified
  REGION 1..184: note = Atopobium sp. oral taxon 810
MSITFASVIPLVPTVLKQRFTSPKSSRRCRAASPGTASRPGSSSAACIALQHVGPELLAHPDDLARLLVAHLRDPVPVHDVGEYQRTIELHPAGSFTIVWYQTRHVIAGEFGNGDARERALGANYAAVQRRVNEMLGTRGPSVDVDALTRAVIRGDYGTTARSAGEGWGRAMRTVQKRVNHMLS

SEQ ID NO: 792 - protein, 252 aa, unidentified
  REGION 1..252: note = Frisingicoccus sp.
MALKVIDISYAQGKVDFEAVRKNVDGVIIRCGYGDDIPNQDDAWWERNASECERLGIPYGAYLYSYAMSRSQAASETNHILRLIRGRKLAYPVYIDLEYEPMRQVFRPEWFIEMGEKIEESGYWFGIYANLDWFRSVIGNRLDRFTRWAAQYNDTLDTYADMWQYTNKGRVAGISGNCDMNICYRNLPDEIRRGWQTDSHLSDTDEAWILETAMDVIRGDYGNGEERRRALGSRYEVVQRKVNELMEKNSFD

SEQ ID NO: 793 - protein, 184 aa, unidentified; identical to SEQ ID NO: 791
  REGION 1..184: note = Atopobium sp. oral taxon 810 str. F0209

SEQ ID NO: 794 - protein, 369 aa, unidentified
  REGION 1..369: note = Arthrobacter phage Caterpillar
MTFSPLINGTVPNNGKYSSRQGKPILKFLQHHWAGTTGGVERMTGPDQASTNYIILTDGRLLGHVPEEFRAWTSGSFDADGDAITVEVQNIHGQVNGNDNDPSSWAISDAAYNTLINLIADVAKRHGWGAVSAGNYQGHRQWFPTACPGGWLWARMDNTRVQANKVLTGGAAAPVPATPPVAGKTVWQLADEVMAGLHGSGDARRVSLGGQYDAVQAEVNRRFGVGAPAPAQKSVAQLADEVLAGAHGNGDQRRASLGNRFDEVQNEINRRLGGGGVAPQGLNIAQLADAVMRGEYGSGQDRINRLGANYNAVQQEVNRRLGGNASPVADINALADAVLRGEYGNGDERVRRLGANYAAVQAEINRRYS

SEQ ID NO: 795 - protein, 371 aa, Bifidobacterium sp.
MALNGIDVSNWKADFDPMRVDFDFLVVQCTWGAGEFTGNGIVNSVWAGADAKIQATIAKGRQFGYMHYIRGAGAAEQEARFFADHTAGYLRKGFPSVDWEAGDNAAYGNIGYLDAFLARYIALTGVPPFVYYSGSDAGRVLPVLRRHDCAAWPAAYGDMNATGYQSTPWGEDRYGGVIRQYSSSGRLPGYAGALDLDIFYGDAATLRMYIDPSGRTPAPDPAPAPARDLNSLADAVIRGEYGDGDTRRRRLGPDYDAVQAIVNRKTTSTASSPTYTVRRGDTLSDIAAKHGTTYQSLARLNDIADPDRIQAGQTLKVPSGTAQNMPRTYTIRSGDTLSAIASAYGTTWQALAAKNRITNPNLIYPGQTIRI

SEQ ID NO: 796 - protein, 327 aa, Bifidobacterium longum
MKNWDTLEADENLLMNTHYTPGRSGRNIDKIVIHHNAGNLSIADCYNLWQTREASAHYQVDANGRIGQLVWDADTAWQADNWDANITSIGIEHADINTSPWTISDATLDNGAHLVAAICKYYGLGRPQWGVNVFPHSRFTATVCPASLAGTQNAAYMAKAQQWYDSMTGGTPAPTPSQPATHGTNLEALADAVIRGEYGNGDERKQRLGSQYDAVMAIVNARYGVTTNTTATSANTGVDIDGLARRVINGEFGVGDARKAALGSNYEAVQARVNQLLAGGTGTSSTDLNALADAVIRGEYGNGAQRQAALGANYAAVQALVNKKLGY

SEQ ID NO: 797 - protein, 327 aa, Bifidobacterium longum
MKNWDTLEADENLLMNTHYTPGRSGRNIDKIVIHHNAGNLSIADCYNLWQTREASAHYQVDANGRIGQLVWDADTAWQADNWDANITSIGIEHADINTSPWTISDATLDNGAHLVAAICKYYGLGRPQWGVNVFPHSRFTATVCPASLAGTQNAAYMAKAQQWYDSMTGGTPAPTPSQPATHGTNLEALADAVIRGEYGNGDERKQRLGSQYDAVMAIVNARYGVTTNTTVTSANTGVDIDGLARRVINGEFGVGDARKAALGSNYEAVQARVNQLLAGGTGTSSTDLNALADAVIRGDYGNGAQRQAALGANYAAVQALVNKKLGY

SEQ ID NO: 798 - protein, 224 aa, unidentified
  REGION 1..224: note = Bifidobacterium tissieri
MRFGKFVGVALAVASLFGVGVAAPSASAMDSASVVSEDTHVAVSVADVVSAHHMVSLNPIGELRAEPEPVDVDTLAQAVLRGEYGDGDERRTRLGRDYAAVQERVNELMPKVVEAPKTVEVSAAPQQRRQSAKPQPKRQAAPKQQMSTPKPSAPQQQKSDVDVLADTMAKADQCTFEDGSGQESCVWHGNNSAGNRVDIYYGTDGNAYKLTDGQGLEVSPRNPE

SEQ ID NO: 799 - protein, 257 aa, Trueperella pyogenes
MSHSYTLNHRQAACFTPGRGGNRITTIVIHHWDDPAKNPSFDGTVGWFVSGRGRNSAHYVVEAGRVTRLVAESDTAWHAGNWPVNQTSIGIECNPRASEADKQTVAALIRDIQSRHGKLRIIGHKDASSTACPGRYYPPTVTLAPYLGSNGGVPAAVKPPAPTAAGGSVDELARAVIAGKYGNGDERRRRLGNRYGEVQARVNELISGKKPAPKPANLDAIANAVLRGEYGNGDERRRLGNLYQPVQDLVNRKLGIR

SEQ ID NO: 800 - protein, 201 aa, Prevotella sp.
MVDNKKQRKSTRSFNMEKHIERHFEIEKEEVPVADTSIEKPDSLIDGSTEENTCTSNNRGKLIAVIVVVLAILAFVAYRSCGSDQEKESEPTNTIVSDSTEKEKPDTASNVKKATAPETEQEQNNVGENTGDVSAAPTNSDEPTKQTSASVSTSNSSVEEKAMQVWDGVYGNGTERKSKLGSDYKAVQKRVNEMYRNGYRR

SEQ ID NO: 801 - protein, 202 aa, unidentified
  REGION 1..202: note = Prevotella sp. P4-119
MVDNKKQRKSTRSFNMEKHVERHFEIEKEEVPVADTPVEKPESLIDGSTEENTCTSNNRGKLITVIVVVLAILAFVAYRSYSSGQEKESEPTKTIVSDSTEKEKTDTTSNVKKKTTAPETEQEQNNVGENTDAASATPTNSDEPTKQASAPISTSNSSVEEKALQVWDGVYGNGTERKSKLGSDYKAVQKRVNEMYRNGYRH

SEQ ID NO: 802 - protein, 102 aa, Atopobium minutum
AELVKNIRARYGNLAMVGHKDIVSTGCPGRYYPPSEVLAPYLGGTTPAPVQASSTPSGPSTNIQALAEAVIIHGEFGNGEERNQRLGALYHKVQRRVNEKLS

SEQ ID NO: 803 - protein, 132 aa, unidentified
  REGION 1..132: note = Atopobium
MWHAGDWVATLESIGIKCNPSCSSSDKRTVAELVKNIRARYGNLAMVGHKDIVSTGCPGRYYPPSEVLAPYLGGTTPAPVQASSTPSGPSTNIQALAEAVIIHGEFGNGEERNQRLGALYHKVQRRVNEKLS

SEQ ID NO: 804 - protein, 36 aa, Collinsella tanakaei
MARRVIAGEFGNGDERKRRLGSYYSIVQRRVNEMLS

SEQ ID NO: 805 - protein, 36 aa, unidentified
  REGION 1..36: note = Bifidobacterium
MARAVIRGDYGNGDERKRRLRSYYSIVQTRVNEMLS

SEQ ID NO: 806 - protein, 498 aa, Collinsella tanakaei
MGLNGIDISSWQDDLVVSAMGTCDFVIVKATGGAGYSNECFRRHADETLAAGKLLSCYHYARDRGYEGTAEAEADCFISAFRPYVGKAIPFLDWEADALSLGPAWAKKWLDRVREKTGVTPGIYTSKSVLFSYDWAAVAKTYPLWVAQYPNYEETGFLSEPWTDGWDFGAWPSPLIFQYTGTGRIPGYGGHLDLDLFYGTRDDWRRLCAVAGASAGTGEVKEVAISRANVAAQIMEHLCNCAEHGYSQPGRHGTSGHCNVKTDAGVVKVTKGDRDCSSAVCEAWELALAGTQYDGLITRYNWTGGMREMFVGSGLFSWKPMSFNASRGDIYLDEENHTAMCIRNDGTADLLGEFSISETGGIDGEPGDQTGRESWIHDYYSGHWDGILHYNGKADTGGASTPTGSGAPSGDVSELAARVIAGEFGNGDARRQALGSRYDEVQAEVNRILSGESSGGSYDVDAMARRVIAGEFGNGDERKRRLGSYYSIVQRRVNEMLS

SEQ ID NO: 807 - protein, 271 aa, Varibaculum cambriense
MNYETLTADVNLIMNKHYTKGRGGHKIDKILVHHNSGRLTTRGCWDTWQTRQASAHYQVEESGKIGQLVWDRNTAWHASNWKANQTSIGIEHANNDTKAWTISPATLEAGAHLVAALCKNYGLGRPEWLKNVFPHQYFANTDCPGQIAHSQRAQYMARAQYWYDTMTGHKTAKPAPATKGVDLEALASAVIAGKYGNGEARRRALGANYQAVQTIVNKRLTGKSKPAPRVDLEALASAVIAGKYGNGQERRRRLGANYAAVQAIVNKRLLG

SEQ ID NO: 808 - protein, 190 aa, Bifidobacterium pseudocatenulatum; identical to SEQ ID NO: 142

SEQ ID NO: 809 - protein, 290 aa, unidentified
  REGION 1..290: note = Caudoviricetes sp.
MAQSHLHLRGKPRRPDRLRATAHRSRLQRAHRHRRVHLDIPHRNNQHPRKPRGNQPRNGRQPCTRPFPHQQNQPQQVKEPTMSFEYITKYNSPNYTPGRPYGIACIVIHWWDDPAKHPTFNGVISTLCSKSRGASANYVAEAGRVACIVDPDNRSWATGDGVGCNSMGNDKGISIECNPRQSDGDYQTIGELIRNIRKTYGDLPLKRHRDLSPRPTSCPGTYDLDRLDRIARHGAASNTPTPSQPSTAGVDLNALADAVIRGEYGVGAERRAKLGANYDKVQQIVNQRLG

SEQ ID NO: 810 - protein, 273 aa, unidentified
  REGION 1..273: note = Caudoviricetes sp.
MNFETLQADQNLLMNKHYTKGRGGHKIDKILIHHNSGRLTTRGCWDTWQTRKASAHYQVEESGKIGQLVWDRDTAWHASNWRANQTSIGIEHANDNVQAMTISPATLEAGAHLVAALCKAYKLGRPEWGKNVFPHQHFANTDCPGQIAHNQRAAYMARAGYWYDQMTGHKAPAPATHTPAAAPNLEALATAVIAGKYGNGAERKRRLGSNYQAVQAIVNRRLTGHKAPAAAPNLEALASAVIAGKYGNGAERKRRLGANYADVQSIVNKRLRG

SEQ ID NO: 811 - protein, 610 aa, unidentified
  REGION 1..610: note = Caudoviricetes sp.
MQGTKTGTNNYPIIRPRNRDKFRYISKFRSKKGTRLGIILLLVLSLSLYTFLYTISDYKNMPYFVYKFIYVITQRERRNEIMLLDANKQRFVGDIAKCVKKYASSYGISVHSPIIAQAILESGWGKSKLAADYHNYFGMKCGTKWTGPSVNMTTQEEYTAGTLTTIKDNFRTYDSMENGVKGYFEFIQLSRYENLKGITDPRQYIETIKNDGYATSSTYVDSLMQIIKLYNLTSYDNAENAGNGGNEMGSRQAMVAKMQSWIGKNEADGSFREVIDIYNSHTPRARGYKLQYSDEWCAGTVSAAAIATGNTDAVPLEVSCHYMIEGAKAKGIWIENDGYVPQSGDIILYDWQDSGAGDNTGNPDHVGVVEYTSGGVIHVIEGNKGRKVARRELSVNGRYIRGFIVPKYSSNTAPGGGSTPSVSGTIDELARRVIAGEFGSGDARKNALGDKYGAVQARVNEILNGTASAPAKKSVTEIAKEVLAGAWGNGDARKQKLEAAGYNYSEVQAKVNSLAGGSSSSVDIDALARRVIAGEFGSGDARKKALGSNYDAVQKRVNEMLGGSSSSVNYAAIAKEVINGKWGNGADRKKKLEAAGYNYKKVQKEVNKLL

SEQ ID NO: 812 - protein, 151 aa, Bifidobacterium bifidum
MGELIRNIRKTYGDLPLKRHRDLSPRPTSCPGTYDLDRLDRIARHGAASNTPTPSQPSTAGVDLNALADAVIRGEYGVGAERRAKLGANYDKVQQIVNQRLGAKPAASNGVDLNALADAVIRGEYGVGAERRAKLGANYDKVQQIVNQRLG

SEQ ID NO: 813 - protein, 68 aa, Bifidobacterium bifidum
MDCPWPASLSSVVAIMPKRKSTCQRIWGRFNAMARAVIRGDYGNGDERKRRLGSYYSIVQTRVNEMLS

SEQ ID NO: 814 - protein, 180 aa, unidentified
  REGION 1..180: note = Atopobiaceae bacterium
MCLGGGKIGHFTGSETGGIDAASVKQTPQCGVCSEQARALSPRSYKALPPKPGDQTGRESRIQDYYRGSWDGVLHYNGKADKGGAPGGSGSGAPSGDASELAERVIAGEFGNGDARRAALGDRYGEVKAEVNRILGYGAVDVDALARRVIAGEFGNGDERKRRLGANYSAVQRRMNEMMS

SEQ ID NO: 815 - protein, 88 aa, Varibaculum cambriense
LEALASAVIAGKYGNGEARRRALGANYQAVQAIVNARLTGKKPAAAPNLEALASAVIAGKYGNGQERRRRLGANYAAVQAIVNKRLLG

SEQ ID NO: 816 - protein, 275 aa, Varibaculum cambriense
MNFETLQADQNLIMNKHYTKGRGGHRIDKILVHHNSGRLTTRGCWDTWQTRQASAHYQVEESGKIGQLVWDRDTAWHAGNWHANQTSIGIEHANNNVKAMTISQATLENGAHLVAALCKAYKLGRPEWGKNVFPHQHFANTDCPGQIAHNQRAAYMARAGYWYDQMTGNHTAPAATPAATSAAAAPNLEALATAVIRGDYGNGEERKRRLGVNYSAVQAIVNARLGGKKPSPPPNLEALATAVIAGKYGNGAERKRRLGANYAAVQAIVNKRLRG

SEQ ID NO: 817 - protein, 209 aa, Bifidobacterium bifidum
MSFEYITKYNSPNYTPGRPYGIACIVIHWWDDPAKHPTFNGVISTLCSKSRGASANYVADAGRVACIVDPDNRSWATGDGVGCNSMGNDKGISIECNPRQSDGDYQTIGELIRNIRKTYGDLPLKRHRDLSPRPTSCPGTYDLDRLDRIARHGAASNTPTPSQPSTAGVDLNALADAVIRGEYGVGAERRAKLGANYDKVQQIVNQRLG

SEQ ID NO: 818 - protein, 88 aa, Varibaculum cambriense
LEALATAVIAGKYGNGEARKRALGANYAAVQAIVNRRLSGSHPAPAPNLEALATAVIAGKYGNGEERRRRLGANYAAVQAIVNKRLLG

SEQ ID NO: 819 - protein, 377 aa, unidentified
  REGION 1..377: note = Arthrobacter phage Stayer
MTFSPLISGTINHNNKYSSRQGRPVLKIVQHHWAGTGGGIERMEGPDQASCTYVILTDGRILGHVPEEFRPWTSGSFEADGDAITIEVQNINGRMDGNDNSPNSWQISDAAYASIIKLIADVARRYGWGGVAVGNYRGHREFSSTACPGGFLWARMDNTRAQAHAAFVGGKPAEAPAPVAPTTSGKTVWQLADEVLAGLHGSGDARKNSLGAQYDAVQAEVNRRFGVGLPATKAPKSVSQLADEVLAGKHGSGDARKASLGARYAEVQNEINRRLGGGGVAPQGVNIGALADAVLRGEFGSGDDRKAKLGVNYDAVQAEVNRRLGGGVAAAPPARTVNIGALADAVIRGEYGSGEDRKKRLGSNYAAVQAEVNRRFK

SEQ ID NO: 820 - protein, 377 aa, unidentified
  REGION 1..377: note = Arthrobacter phage Shiba
MTFSPLISGTINHNNKYSSRQGRPVLKIVQHHWAGTGGGIERMEGPDQASCTYVILTDGRILGHVPEEFRPWTSGSFEADGDAITIEVQNINGRMDGNDNSPNSWQISDAAYASIIKLIADVARRYGWGGVAVGNYRGHREFSSTACPGGFLWARMDNTRAQAHAAFVGGKPAEAPAPVAPTTSGKTVWQLADEVLAGLHGSGDARKNSLGAQYDAVQAEVNRRFGVGLPATKAPKSVSQLADEVLAGKHGSGDARKASLGSRYAEVQNEINRRLGGGGVAPQGVNIGALADAVIRGEFGSGDDRKAKLGVNYDAVQAEVNRRLGGGVAAAPPARTVNIGALADAVIRGEYGSGEDRKKRLGSNYAAVQAEVNRRFK

SEQ ID NO: 821 - protein, 377 aa, unidentified
  REGION 1..377: note = Arthrobacter phage StarLord
MTFSPLISGTINHNNKYSSRQGRPVLKIVQHHWAGTGGGIERMEGPDQASCTYVILTDGRILGHVPEEFRPWTSGSFEADGDAITIEVQNINGRMDGNDNSPNSWQISDAAYASIIKLIADVARRYGWGGVAVGNYRGHREFSSTACPGGFLWARMDNTRAQAHAAFVGGKPAEAPAPVAPTTSGKTVWQLADEVLAGLHGSGDARKNSLGAQYDAVQAEVNRRFGVGLPATKAPKSVSQLADEVLAGKHGSGDARKASLGSRYAEVQNEINRRLGGGGVAPQGVNIGALADAVLRGEFGSGDDRKAKLGVNYDAVQAEVNRRLGGGVAAAPPARTVNIGALADAVIRGEYGSGEDRKKRLGSNYAAVQAEVNRRFK

SEQ ID NO: 822 - protein, 151 aa, Bifidobacterium bifidum
MGELIRNIRKTYGDLPLKRHRDLSPRPTSCPGTYDLDRLDRIARHGAASNTPTPSQPSTAGVDLNALADAVIRGEYGVGAERRAKLGANYDKVQAIVNQRLGAKPAASNGVDLNALADAVIRGEYGVGAERRAKLGANYDKVQQIVNQRLG

SEQ ID NO: 823 - protein, 414 aa, Bifidobacterium dentium
MKPLLKRLRKAICATIATLCVGGMTAGVALADMNGIDVSGWQAPDITSVVDADFAIVKVNQGTWLNSSWRTQAANAVNTGKELGLYDYASGMNATAEADAFVDRIGGYVGKAMLVLDWESYQNSAFGNSSWIREWVNRVHERTGVWPVVYCSKSVVSQIPSDVRAHCMLWAAQYANNNATGYQSSPWNAGSSGEGMLQYSSSGYLNGRGPLDLNKFFGDRTAWRKIACGERQGCSTSGSGSTGTTSKPTTTTKTETTTDTTDLNALASAVIRGEYGNGQDRRNRLGSNYDKVMAIVNSRLTGSTYTGSTTVTTTVTRTYVVRSGDTVSAVANRLGLLPVSAWRAPSGNLNRIYVGQTITYTGSTTTATTTSTSSTHVVRSGESLWSIYGTGWPAAASRNGLRYPYTIYPGQRLI

SEQ ID NO: 824 - protein, 258 aa, Bifidobacterium bifidum
MSFEYITKYNSPNYTPGRPYGIACIVIHWWDDPAKHPTFNGVISTLCSKSRGASANYVAEAGRVACIVDPDNRSWATGDGVGCNSMGNDKGISIECNPRQSDGDYQTIGELIRNIRKTYGDLPLKRHRDLSPRPTSCPGTYDLDRLDRIARHGAASNTPTPSQPSTAGVDLNALADAVIRGEYGVGAERRAKLGANYDKVQAIVNQRLGAKPAASNGVDLNALADAVIRGEYGVGAERRAKLGANYDKVQQIVNQRLG

SEQ ID NO: 825 - protein, 271 aa, Varibaculum cambriense
MNFETLTADVNLIMNKHYTKGRGGHKIDKILVHHNSGRLTTRGCWDTWQTRQASAHYQVEESGRIGQLVWDRDTAWHASNWRANQTSIGIEHANNDTKAWTISPATLEAGAHLVAALCKAYKLGRPEWLKNVYPHQYFANTDCPGQIAHSQRAQYMARAQAWYDAMTGNHPAPAPAPAAKGVDLEALASAVIAGKYGNGEARRRALGANYQAVQAIVNARLTGKKPAAAPNLEALASAVIAGKYGNGQERRRRLGANYAAVQAIVNKRLLG

SEQ ID NO: 826 - protein, 332 aa, Bifidobacterium scardovii
MKNWDTLEADEDMILTTHYTPGRSGRKIDKVLVHHNAGNLSIAGCYSVWQTREASAHYQVDANGRIGQLVWDADTAWHAGNWEANLTSIGIEHADISTNPWKVSDATLDNGAHLVAALCKHYGLGRPAWGVNVFPHSAFSSTECPASLYGSQKDAYMAKAQAWYDSMTGGKPAPKPSTPAPAPQAADLNALADAVIRGDYGNGETRRARLGDKYDAVMAIVNQRYGITAGSNGNSGGGNGGASIDDLARRAINGEFGNGEQRKAALGANYQAVQARVNQMLGQGGGSAPSVDLNALADAVIRGDYGNGDQRRNALGANYAAVQAIVNKKLGY

SEQ ID NO: 827 - protein, 258 aa, Bifidobacterium bifidum
MSFEYITKYNSPNYTPGRPYGIACIVIHWWDDPAKHPTFNGVISTLCSKSRGASANYVAEAGRVACIVDPDNRSWATGDGVGCNSMGNDKGISIECNPRQSDGDYQTIGELIRNIRKTYGDLPLKRHRDLSPRPTSCPGTYDLDRLDRIARHGAASNTPTPSQPSTAGVDLNALADAVIRGEYGVGAERRAKLGANYDKVQQIVNQRLGAKPAASNGVDLNALADAVIRGEYGVGAERRAKLGANYDKVQQIVNQRLG

SEQ ID NO: 828 - protein, 329 aa, Bifidobacterium breve
MKNWDTLEADEDLILNTHYTPGRSGRKISKILVHHNAGNLSIAGCYSVWQTREASAHYQVQADGRIGQLVWDSDTAWHAGNWEANLTSIGIEHADISTNPWRVSDATLDNGAHLVAALCRYYGLGRPQWGVNVFPHSAFTGTACPASLYGSQKDAYMAKAQAWYDAMTGGKPAPAPSNPAPQATDLNALADAVIRGDYGNGDTRRARLGDKYDAVMAIVNQRYSITAGNNGNGGGNGGANIDDLARRAINGEFGNGEARKAALGANYAAVQARVNQMLGQGGGSAPSVDLNALADAVIRGDYGNGDQRRNALGANYAAVQVIVNKKLGY

SEQ ID NO: 829 - protein, 91 aa, Olsenella profusa
MREGRPPPRPWHLHHRGDFRLWGRLKSGAGWICLDYTSQTKTAKSSASKTIDIDTLAQAVIRGDYGSGGECKRRLGSNYAAVQKHVNDLLK

SEQ ID NO: 830 - protein, 334 aa, Bifidobacterium pseudolongum
MKNWDKLEADRDLILNKHFTGGRNGCRIDKVILHHNGGNLSGEGCYNVWQTREASAHYQVDANGVITQIVWDGDTAWHAGNYQANCTSIGIEHADICTNPWKISDATLDNGAHLTAAVCKYYGLGRPQYGKNVFFHKDFSPTECPASIAGSQRDAYMRRAQEWYDRMTGSKPSSPAKPAAKPSAPSKKSVETVAREVIAGQWGNGADRMNRLKAAGYDPNAVQAKVNELCGVGSAPAPAVNIDAVARDVINGKYGNGTDRMNRLRASGYDPNAVQARVNQMLGAGGTPATKPDVNIDDLARRTIAGEFGNGAERQRRLGSNYAAVQARVNQMLG

SEQ ID NO: 831 - protein, 331 aa, unidentified
  REGION 1..331: note = Bifidobacterium
MKNWDTLEADEDLILNTHYTPGRSGRKITRILVHHNAGNLSIAGCYSVWQTREASAHYQVQADGCIGQLVWDSDTAWHAGNWEANLTSIGIEHADISTNPWQVSDATLDNGSHLVAALCRYYGLGRPQWGVNVFPHSAFSSTECPASLYGSQKDAYMAKAQAWYDSMTGGKPAPKPSTPVPAPQPTDLNALADAVIRGDYGNGDTRRARLGDKYDAVMAIVNQRYGITAGAGGNNSGNGGASIDDLARRAINGEFGNGDQRRAALGSNYAAVQARVNQMLGQGGGSAPSVDLNALADAVIRGDYGNGDQRRNALGANYAAVQAIVNKKLGY

SEQ ID NO: 832 - protein, 324 aa, Bifidobacterium pseudolongum
MSNYNYLTQYDAACFTPGRPYGIDAITIHWWDDPTVRRPSFDTVINLFVSGSRQTSAHYVAEAGRVACLVAPGDRAWACGDGINVGSGGNDKSISIECNWRQSDGDYDTIAQLIADLRKTYGDLPLKPHRTWTSTDCPGTYDLARLDRLARQKAGEKLPTASTPAKPAAKPAGGKLSVDQVAREVINGKWGNGADRMAKLKAAGYDAAAVQARVNEICGMSGAAGPAPAANIDAIARDVINGAYGNGADRMNRLKAAGYDPNAVQARVNQMLGANGTPATKPAVNIDDLARRTIAGEFGNGAERQRRLGSNYAAVQARVNQMLG

SEQ ID NO: 833 - protein, 334 aa, Bifidobacterium pseudolongum
MKNWDKLEADRDLILNKHFTGGRNGCRIDKVILHHNGGNLSGEGCYNVWQTREASAHYQVDANGVITQIVWDGDTAWHAGNYQANCTSIGIEHADICTNPWKISDATLDNGAHLTAAVCKYYGLGRPQYGKNVFFHKDFSPTECPASIAGSQRDAYMRRAQEWYDRMTGSKPSSPAKPAAKPSAPSKKTIETVAREVIAGQWGNGADRMNRLKAAGYDPNAVQAKVNELCGVGSAPAPAVNIDAVARDVINGKYGNGTDRMNRLRASGYDPNAVQARVNQMLGAGGTPATKPDVNIDDLARRTIAGEFGNGAERQRRLGSNYAAVQARVNQMLG

SEQ ID NO: 834 - protein, 209 aa, Bifidobacterium bifidum
MSFEYITKYNSPNYTPGRPYGIACIVIHWWDDPAKHPTFNGVISTLCSKSRGASANYVAEAGRVACIVDPDNRSWATGDGVGCNSMGNDKGISIECNPRQSDGDYQTIGELIRNIRKTYGDLPLKRHRDLSPRPTSCPGTYDLDRLDRIARHGAASNTPTPSQPSTAGVDLNALADAVIRGEYGVGAERRAKLGANYDKVQQIVNQRLG

SEQ ID NO: 835 - protein, 279 aa, Bifidobacterium pseudolongum
MKNWDTLEADENLILNKHYTGGRNGKSIDKVIIHHNGGNLSIRGCYDTWQTREASAHYQVDSNGRIGQYVWDSDTAWHAGNYDANCTSIGIEHADISTNPWRVSDACLDNGAHLTAAVCKFYKLGRPQLNKNVFFHKQFSATECPASLAGSQKDAYIKRAQEWYDKMTGTKPAATTTSKPTATPAKKSVETIAREVIAGQWGNGTDRTRRLKAAGYDAAAVQTRVNQLLGVSTPKPNVDLNALADAVIRGEYGNGEQRRKALGANYEAVQAIVNKKMGW

SEQ ID NO: 836 - protein, 329 aa, unidentified
  REGION 1..329: note = Bifidobacterium
MKNWDTLEADEDLILNTHYTPGRSGRKISKILVHHNAGNLSIAGCYSVWQTREASAHYQVQADGRIGQLVWDSDTAWHAGNWEANLTSIGIEHADISTNPWRVSDATLDNGAHLVAALCRYYGLGRPQWGVNVFPHSAFTGTACPASLYGSQKDAYMAKAQAWYDAMTGGKPAPAPSNPAPQATDLNALADAVIRGDYGNGDTRRARLGDKYDAVMAIVNQRYGITAGNNGNGGGNGGANIDDLARRAINGEFGNGEARKAALGANYAAVQARVNQMLGQGGGSAPSVDLNALADAVIRGDYGNGDQRRNALGANYAAVQVIVNKKLGY

SEQ ID NO: 837 - protein, 329 aa, Bifidobacterium longum
MKNWDTLEADEDLILNTHYTPGRSGRKISKILVHHNAGNLSIAGCYSVWQTREASAHYQVQADGRIGQLVWDSDTAWHAGNWEANLTSIGIEHADISTNPWRVSDATLDNGAHLVAALCRYYGLGRPQWGVNVFPHSAFTGTACPASLYGSQKDAYMAKAQAWYDAMTGGKPAPAPSNPAPQATDLNALADAVIRGDYGNGDTRRARLGDKYDAVMAIVNQRYGITAGNNGNGGGNGGANIDDLARRAINGEFGNGEARKAALGANYAAVQARVNQMLGQGGGSAPSVDLNALADAVIRGDYGNGDQRRNALGANYAAVQAIVNKKLGY

SEQ ID NO: 838 - protein, 258 aa, Trueperella pyogenes
MSNTYTLNHRQAACFTPGRGGNRITTIVIHHWDDPAKNPSFNGTVDWFVTGRGRNSAHYVVEAGRVTRMVAESDTAWHAGNWPVNQTSIGIECNPRASEADKQTVAALIRDIQSRHGKLRIIGHKDASSTACPGRYYPPTVTLAPYLGGNSGVPAAVKPPAPTAAGGSVDELARAVIAGKYGNGDERRRRLGNRYSEVQARVNELISGKKPAPKPANLDAIANAVLRGEYGNGDERRRRLGNLYQPVQDLVNRKLGIR

SEQ ID NO: 839 - protein, 414 aa, Bifidobacterium dentium
MKPLLKRLRKAICATIATLCAGGMAAGVALADMNGIDVSGWQTPDITAVVRADFAIVKVNQGTWLNGSWRTQAANAISSGKELGLYDYASGMNATAEADAFVDRIGGYVGKAMLVLDWESYQNSAFGNSSWIREWVNRVHERTSVWPVVYCSKSVVYQIPSDVRAHCMLWAAQYANNNATGYQSSPWNAGSSGEGMLQYSSSGYLNGRGPLDLNKFFGDRTAWRKIACGERQGCSTSGTGSTGTASAPSTTTKTETTTTTTDLNALATAVIRGEYGNGQDRRNRLGSNYDKVMAIVNSRLTGSTYTGSTTVTTTVTRTYVVRSGDTVSAVANRLGLLPVSAWRVPSGNLNRIYVGQTITYTGSTTTATATSTSSSHVVRAGESLWSIYGTGWSAAASRNGLRYPYTIYPGQRLI

SEQ ID NO: 840 - protein, 498 aa, Collinsella tanakaei; identical to SEQ ID NO: 806

SEQ ID NO: 841 - protein, 326 aa, unidentified
  REGION 1..326: note = Adlercreutzia sp. ZJ138
MSMSRANVAAQVMEHLCSCPEHGYSQPGRHGASGHCSVMTDAGTIRVTKGDRDCSSAVCEAWELALAGTAYAGLITRYNWTGGMREMFVGSGLFSWEPMSFSASRGDVYLDESSHAAMCVRNDGAADLLAEFSISETGGIDGAPGDQTGRESRVRGYYSGRWDGILHYNGKADGGGAAAPAGHGGPSGDASKLARRVIAGEFGNGDARREALGDRYSEVQAEVNRILSGGASSGGASADVDALARRVIAGEFGNGDARKAALGDKYAAVQKRVNEMLGGGAAGTTVDVDTMARAVIRGDYGDGDARKRRLGSYYMAVQRRVNEMLA

SEQ ID NO: 842 - protein, 391 aa, Bifidobacterium dentium
MTAGVALADMNGIDVSGWQAPDITSVVDADFAIVKVNQGTWLNSSWRTQAANAVNTGKELGLYDYASGMNATAEADAFVDRIGGYVGKAMLVLDWESYQNSAFGNSSWIREWVNRVHERTGVWPVVYCSKSVVSQIPSDVRAHCMLWAAQYANNNATGYQSSPWNAGSSGEGMLQYSSSGYLNGRGPLDLNKFFGDRTAWRKIACGERQGCSTSGSGSTGTTSKPTTTTKTETTTDTTDLNALASAVIRGEYGNGQDRRNRLGSNYDKVMAIVNSRLTGSTYTGSTTVTTTVTRTYVVRSGDTVSAVANRLGLLPVSAWRAPSGNLNRIYVGQTITYTGSTTTATTTSTSSTHVVRSGESLWSIYGTGWPAAASRNGLRYPYTIYPGQRLI

SEQ ID NO: 843 - protein, 315 aa, unidentified
  REGION 1..315: note = Schaalia sp. lx-100
MSSYEEITSHTSPAYTGGRPYGVARIVLHHWGDPASGPTFEGVVAYLTRANATTSAHYVAEAGRVACIVDPDDRAWHAGDGIGVGSAGNDMGIAIECNPRASEGDVATVAELVADLRSVYGDLPLAVHSDFVATQCPGAYRDLVGRIDAHAREITLPQASVARPAPAAPAFSADSIDGLARRVLAGEYGNGEDRKAALGGMYDAVQARVNELCGMGGPSQPAGVDAVARDVIAGAYGNGEARYAALRAAGYDPDAVQARVNELLGASPAPASGGPDVEALAQAVIRGEYGNGEDRKAALGGAYDAVQARVNEILS

SEQ ID NO: 844 - protein, 271 aa, Varibaculum cambriense; identical to SEQ ID NO: 807

SEQ ID NO: 845 - protein, 216 aa, Bifidobacterium dentium
MASVAEFIQCDSRNYTAGRQGNRIRKIVVHYTGTEASAHNNLLYFSRSSAGASAHYFIDKDGTLRQLVSEGDTAWHAGHWATNLCSVGIEVVSGGADFTEAQINTLATLVADIRSRCGVSADDVIRHYDVTGKLCPAPYVDGSKWAALHERICGGAASSGGGSGSGGSGGGPAPSGDVSELARRVINGEFGNGEERRQRLGANYAAVQRRVNEMLS

SEQ ID NO: 846 - protein, 326 aa, Bifidobacterium pseudolongum
MSDYNYLTQYDAACFTPGRPYGITAITIHWWDDPTVRRPSFDTVINLFVTGSRQTSAHYVAEAGRVACLVAPGDRAWACGDGINVGSGGNDKSISIECNWRQSDGDYDTIAQLIADLRKTYGNLPLKPHRNWTSTDCPGTYDLARLDRLARQKAGEKLPTVSAPAKPATTPANGKLSVDQVAREVINGKWCNGADRMAKLKAAGYDAAAVQARVNEICGMSGAAGPAPAANIDAIARDVINGAYGNGADRMNRLKAAGYDPNAVQARVNQMLGANGSTQTTKPAVNIDDLARRVIAGEFGNGDARRRALGANYDAVQARVNQMLGQ

SEQ ID NO: 847 - protein, 271 aa, Varibaculum cambriense
MNYETLTADVNLIMNKHYTKGRGGHKIDKILVHHNSGKLTTRGCWDTWQTRQASAHYQVEESGRIGQLVWDRDTAWHASNWKANQTSIGIEHANNDTKAWTISPATLEAGAHLVAALCKNYGLGRPEWLKNVFPHQYFANTDCPGQIAHSQRAQYMARAQYWYDEMTGHKTAKPAPATKGVDLEALATAVIAGKYGNGEARRRALGANYQAVQAIVNKRLTGKSKPAPRVDLEALASAVIAGKYGNGQERRRRLGANYAAVQAIVNKRLLG

SEQ ID NO: 848 - protein, 274 aa, unidentified
  REGION 1..274: note = uncultured Varibaculum sp.
MMNFETLQADQNLLMNKHYTKGRGGHKIDKILIHHNSGRLTTRGCWDTWQTRKASAHYQVEESGKIGQLVWDRDTAWHASNWRANQTSIGIEHANDNVQAMTISPATLEAGAHLVAALCKAYKLGRPEWGKNVFPHQHFANTDCPGQIAHNQRAAYMARAGYWYDQMTGHKAPAPATHTPAAAPNLEALATAVIAGKYGNGAERKRRLGSNYQAVQAIVNRRLTGHKAPAAAPNLEALASAVIAGKYGNGAERKRRLGANYADVQSIVNKRLRG

SEQ ID NO: 849 - protein, 528 aa, unidentified; identical to SEQ ID NO: 163
  REGION 1..528: note = uncultured Catenibacterium sp.

SEQ ID NO: 850 - protein, 61 aa, Bifidobacterium pseudocatenulatum
MQARVNELISGKKPAPKPANLDAIANAVLRGEYGNGDERRRRLGNLYQPVQDLVNRKLGIR

SEQ ID NO: 851 - protein, 105 aa, unidentified
  REGION 1..105: note = uncultured Olegusella sp.
MQARVNEILGGGASSGGGGVDVDNLARRVIAGEFGNGDERRDRLGSNYAKVQKRVNEILGSGSDVDIDDLARRVINCEFGNGQERKDRLGPNYAAVQRRVNELLG

SEQ ID NO: 852 - protein, 102 aa, Bifidobacterium pseudocatenulatum
MKPPAPTAAGGSVDELARAVIAGKYGNGDERRRRLGNRYGEVQARVNELISGKKPAPKPANLDAIANAVLRGEYGNGDERRRRLGNLYQPVQDLVNRKLGIR

SEQ ID NO: 853 - protein, 256 aa, unidentified
  REGION 1..256: note = Actinotignum urinale
MAYDYITAYDARSYTPGREGRSIDTIVVHHWDDPEKKPRFEGVLNWFCHSAPTSAHYVVEAGRVACLVSCADTAYHAGNWGMNLRSIGIECNPRASEEDKATVGELIANLQATYGNLRIIGHKDVKNTGCPGRYYPPAQILAPYIKQGGGAVASQPTPAPSTGGTDINALANAVLRGEYGNGADRRARLGGLYDTVQAVVNQKLGATGNTRGAGVDINALADGVLKGLYGNGAERRQRLGVHYDAVQAEVNRRLGY

SEQ ID NO: 854 - protein, 256 aa, unidentified
  REGION 1..256: note = Actinotignum urinale
MAYDYITAYDARSYTPGREGRSIDTIVVHHWDDPEKKPRFEGVLNWFCHSAPTSAHYVVEAGRVACLVSCADTAYHAGNWNMNLRSIGIECNPRASEEDKATVGELIANLQATYGNLRIIGHKDVKNTGCPGRYYPPAQILAPYIKQGGGAVASQPTPAPSTGGTDINALANAVLRGEYGNGADRRARLGGLYDTVQAVVNQKLGATGNTRGAGVDINALADGVLKGLYGNGAERRQRLGVHYDAVQAEVNRRLGY

SEQ ID NO: 855 - protein, 242 aa, Bifidobacterium bifidum
MSFEYITKYNSPNYTPGRPYGIACIVIHWWDDPAKHPTFNGVISTLCSKSRGASANYVAEAGRVACIVDPDNRSWATGDGVGCNSMGNDKGISIECNPRQSDGDYQTIGELIRNIRKTYGDLPLKRHRDLSPRPTSCPGTYDLDRLDRIARHGAASNTPTPSQPSTAGVDLNALADAVIRGEYGVGAERRAKLGANYDKVQQIVNQRLGAKPAASNGVDLNALADAVIRGEYGVGAERRAKL

SEQ ID NO: 856 - protein, 258 aa, Trueperella pyogenes
MSHSYTLNHRQAACFTPGRGGNRITTIVIHHWDDPAKNPSFDGTVGWFVSGRGRNSAHYVVEAGRVTRMVAESDTAWHAGNWPVNQTSIGIECNPRASEADKQTIAALIRDIQSRHGKLRIIGHKDASSTACPGRYYPPAQVLAPYLGGNGGVPAAVKPPAPTAAGGSVDELARAVIAGKYGNGDERRRRLGNRYSEVQARVNELISGKKPAPKPANLDAIANAVLRGEYGNGDERRRRLGNLYQPVQDLVNRKLGIR

SEQ ID NO: 857 - protein, 129 aa, Arcanobacterium hippocoleae
MPSQKFVNTSCPGIWERYLAWLDTRANQILTGQNPTAPAPQAFDIEQAARAVIAGKYGNGEQRKSALGANYQAVQARVNEILSGKPTPNIDALAREVLAGKYGNGAERRQALGANYEAVQARVNEILGV

SEQ ID NO: 858 - protein, 234 aa, unidentified
  REGION 1..234: note = Muribaculaceae bacterium
MANKGNFNFEKGGNKPNPDKGANGKINLDKNNSDELVNGIEVDEYGNPVGPVRTPQPEDPASVLEPDLSEESVKDAIENGPEEPKKKGFAWLWAIIGIAVVLGFLGMVFLKKGEKSEEPAKAEETETVAPAVDSTIAQDSAVMPAENVEASENSESQNVAPETSATSNSAASETAQTSAASSNVPAAVSGEIETESLKAIRGDYGNGNARREQLGSRYSEIQSRVNEMKRAGKF

SEQ ID NO: 859 - protein, 236 aa, unidentified
  REGION 1..236: note = Muribaculaceae bacterium
MANKGNFNFEKGGNKPNPDKGANGKINLDKNNSDELVNGIEVDEYGNPVGPVRTPQPEDPASVLEPDLSEESVKDAIENGPEEPKKKGFAWLWAIIGIAVVLGFLGMVFLKKGEKSEEPAKAEETETVAPAVDSTIAQDSAVMPAENVEASENSESQQVASETSATSNPNSAPSETAQTSAASSNVPAAVSGEIETESLKAIRGDYGNGNARREQLGSRYSEIQSRVNEMKRAGKF

SEQ ID NO: 860 - protein, 110 aa, unidentified
  REGION 1..110: note = Eubacteriales bacterium
MSDLEKKVEKLADEELGNVAGGASANYLAALDVMAGKYGNGEERRRRLAAAGYNYDAVQHLVNGLAKGYDRVAREVIAGKYGNDQYRVNALRAAGYDARLVQDLVNEILK

SEQ ID NO: 861 - protein, 225 aa, Bacteroides sp.
MANPDNRRKPPGNINLDKGERSTNLEKEGAQGVELTPEEEAAQHNNGRTGSASSASRQTPGSASRNSGWGGDGNSIPPSSPDPGKKKGYGKAWLWVILAIVAVVIIIWIMPKGCTEAKEDQEAVALTETTANVSDSVTVEADSNVGAVQVASQEVAAVTDNSDKTSSASAPAAKPTSKVSDNVEQEALNVIRGEYGNNPQRRSALGQDYDAVQRRVNQMMRSGKY

SEQ ID NO: 862 - protein, 216 aa, unidentified
  REGION 1..216: note = Muribaculaceae bacterium
MKRDARKAVDDVQGRIEQGPVQEQISDHSEVFDDMAEYEAADQLVDDSKKAAKNRGWMWVAVAVALLIGAALCVLMIPELTGSKVENAVAVAKAGATKAVNGATDAVGQGMAVVENAGSNVISAADSLVSGAADAVAAKASDVSAAVGGKAASVATDVKTAASDAVQTSDNATAAEIEDEARKVIHGDYGNGAQRRQALGSHYAAVQHRVNELLHA

SEQ ID NO: 863 - protein, 226 aa, unidentified
  REGION 1..226: note = Muribaculaceae bacterium
MANPDNRRKTPGSFNLDKGERSINLEKEGTQVPELTAEEEAAQQNAPQTASESTASRSTAGPSGGQSSDRGRGATPPPSNPEPRRNRGNGRAWLWVILAIVAVIIIVWIMPKSCTEAKEDNEPSKLTETVEAVENDSVSAKTDSVVTAVTTPVQEAAEPKETDKPMPVEAPAVEKNTSKVSDNVEQEALNVIRGEYGNNPQRRSALGKDYDAVQRRVNQMMRSGKY

SEQ ID NO: 864 - protein, 138 aa, unidentified
  REGION 1..138: note = Frisingicoccus sp.
GEKIEESGYWFGIYANLDWFRSVIGNRLDRFTRWAAQYNDTLDTYADMWQYTNKGRVAGISGNCDMNICYRNLPDEIRRGWQTDSHLSDTDEAWILETAMDVIRGDYGNGEERRKALGSRYEVVQRKVNELMEKNSFD

SEQ ID NO: 865 - protein, 252 aa, unidentified
  REGION 1..252: note = Frisingicoccus sp.
MALKVIDISYAQGKVNFEAVRKNVDGVIIRCGYGDDIPNQDDAWWERNASECERLGIPYGAYLYSYAMSRSQAASETNHILRLIRGRKLAYPVYIDLEYDPMRQVFRPEWFIEMGEKIEESGYWFGIYANLDWFRSVIGNRLDRFTRWAAQYNDTLDTYADMWQYTNKGRVEGIYGDCDMNICYRNLPDEIRPGWKMNGHLSYTDEAWILETAMDVIRGNYGNGEERRKALGSRYEVVQRKVNEIMEKNSFD

SEQ ID NO: 866 - protein, 253 aa, unidentified
  REGION 1..253: note = Frisingicoccus sp.
MMALKVIDISYAQGKVDFEAVRENVDGVIIRCGYGDDITDQDDAWWERNASECERLGIPYGAYLYSYAMSQRQAESETNHILRLIRGRKLAYPVYIDLEYEPMRQVFRPEWFIEMGEKIEKSGYWFGIYANLDWFRSVIGNRLDRFTRWAAQYNDTLDTYADMWQYTNKGRVEGIYGDCDMNICYRNLPDEIRPGWKMNGHLSYTDEAWILETAMDVIRGNYGNGEERRKALGSRYEVVQRKVNEIMEKNSFD

SEQ ID NO: 867 - protein, 252 aa, unidentified
  REGION 1..252: note = Frisingicoccus sp.
MALKVIDISYAQGKVDFEAVRKNVDGVIIRCGYGDDIPNQDDAWWERNASECERLGIPYGAYLYSYAMSRSQAASETNHILRLIRGRKLAYPVYIDLEYEPMRQVFRPEWFIEMGEKIEESGYWFGIYANLDWFRSVIGNRLDRFTRWAAQYNDTLDTYADMWQYTNKGRVAGISGNCDMNICYRNLPDEIRRGWQTDSHLSDTDEAWILETAMDVIRGDYGNGEERRKALGSRYEVVQRKVNELMEKNSFD

SEQ ID NO: 868 - protein, 252 aa, unidentified
  REGION 1..252: note = Frisingicoccus sp.
MALKVIDISYAQGKVDFGAVRGNVDGVIIRCGYGDDIPDQDDACWERNASECERLGIPYGAYLYSYAMSRRQAESETNHILRLIRGRKLAYPVYIDLEYEPMRQVFRPEWFIEMGQKIEESGYWFGVYANLDWFHSVIGNRLDRFTRWAAQYNDTLDTYADMWQYTNKGRVEGISGDCDMNICYRNLPDEIRRGWQTDSHLSDTDEAWILETAMDVIRGNYGNGEDRRRALGSRYEVVQRKVNEIMEKNSFD

SEQ ID NO: 869 - protein, 290 aa, unidentified
  REGION 1..290: note = Bacteriophage sp.
MQRVIDVSYHNGKVNWELVKAAGYHAILRAGYGTDRSDQDDTEFKRNADACERLGIPWGAYLYSYADNTTRAMSEAAHMIRLLEPYKDARYRLYPCFFDAEQAGTEDAAAGNAVIWCRQLAAEGYDTGVYANEHWWSTVLKYVRTGCRWVAKWSSRAPSVAWDIWQCTDRADVPGCTGNGGRTDLSQSKLDISAPPIYEGPEGPGDMTADELADAVERGDYGNGENRRRALGGRYDVVQLIVNLRNGSTAGIGKVADDVIADRYGKGEARKIALGSAYKPVQKLVNKKLK

SEQ ID NO: 870 - protein, 327 aa, unidentified
  REGION 1..327: note = Caudoviricetes sp.
MKNWETLEADEDMILNTHFTPGRSGRNIDKIVIHHNAGNLSIAGCYNVWQTREASAHYQVDSNGRIGQLVWDADTAWHAGDWAANTTSIGIEHADINTNPWQCSDATIDNGAHLVAALCKYYELGRPQWGVNVFPHSRFSATECPASLAGTQNAVYMAKAQYWYDKMSGGNPSTPSTPSQPQQHATNLEALADAVIRGDYGNGDERKQRLGSQYDAVMAIVNARYGIASGGSSASVNIDDLARRVINGEFGVGDARKAALGSNYEAVQARVNQLLGQGGGGSAPSVDLNALADAVIRGDYGNGAQRQAALGANYAAVQAIVNKKLGY

SEQ ID NO: 871 - protein, 327 aa, Bifidobacterium breve
MKNWDTLEADENLLMNTHYTPGRSGRNIDKIVIHHNAGNLSIAGCYNLWQTREASAHYQVDANGRIGQLVWDADTAWHAGDWAANITSIGVEHADINTNPWTISDATLDNGAHLVAALCKYYGLGRPQWCVNVFPHSRFSATECPTSLAGTQNAAYMAKARQWYDSMTGGTPAPTPSQPATHGTNLEALADAVIRGDYGNGDERKQRLGSQYDAVMAIVNARYGVTTNTTVTSTNTGVDIDGLARRVINGEFGVGDARKAALGSNYEAVQARVNQLLAGGTGTSSTDLNALADAVIRGDYGNGAQRQAALGANYNAVQALVNKKLGY

SEQ ID NO: 872 - protein, 327 aa, unidentified
  REGION 1..327: note = Bifidobacterium
MKNWDTLEADENLLMNTHYTPGRSGRNIDKIVIHHNAGNLSIAGCYNLWQTREASAHYQVDANGRIGQLVWDADTAWHADDWDANITSIGVEHADINTNPWTISDATLDNGAHLVAALCKYYGLGRPQWCVNVFPHSRFSATECPTSLAGTQNAAYMAKAQQWYDSMTGGTPAPTPSQPATHGTNLEALADAVIRGDYGNGDERKQRLGSQYDAVMAIVNARYGVTTNTTVTSTNTGVDIDGLARRVINGEFGVGDARKAALGSNYEAVQARVNQLLAGGTGTSSTDLNALADAVIRGDYGNGAQRQAALGANYNAVQALVNKKLGY

SEQ ID NO: 873 - protein, 327 aa, unidentified
  REGION 1..327: note = Bifidobacterium
MKNWETLEADEDMILNTHFTPGRSGRNIDKIVIHHNAGNLSIAGCYNVWQTREASAHYQVDSNGRIGQLVWDADTAWHAGDWAANTTSIGIEHADINTNPWQCSDATIDNGAHLVAALCKYYELGRPQWGVNVFPHSRFSATECPASLAGTQNAAYMAKAQYWYDKMSGGNPSTPSTPSQPQQHATNLEALADAVIRGDYGNGDERKQRLGSQYDAVMAIVNARYGIASGGSSASVNIDDLARRVINGEFGVGDARKAALGSNYEAVQARVNQLLGQGGGGSAPSVDLNALADAVIRGDYGNGAQRQAALGANYAAVQAIVNKKLGY

SEQ ID NO: 874 - protein, 327 aa, Bifidobacterium longum
MKNWDTLEADENLLMNTHYTPGRSGRNIDKIVIHHNAGNLSIAGCYNLWQTREASAHYQVDANGRIGQLVWDADTAWHADDWDANITSIGVEHADINTNPWTISDATLDNGAHLVAALCKYYGLGRPQWCVNVFPHSRFSATECPTSLAGTQNAAYMAKAQQWYDSMTGGTPAPTPSQPATHGTNLEALADAVIRGDYGNGDERKQRLGSQYDAVMAIVNARYGVTTNTTVTSTNTGVDIDGLARRVINGEFGVGDARKAALGSNYEAVQARVNQLLAGGTGTSSTDLNALADAVIRGDYGNGAQRQAALGANYAAVQAIVNKKLGY

SEQ ID NO: 875 - protein, 286 aa, unidentified
  REGION 1..286: note = Methanobrevibacter sp.
MNGIDISNWQGGKTPSNYNIDFCICKATEGTNFVDDFCDGFIQDCIRNNILFGYYHFARNGNAKSEAKFFWNNTLGYSGYGIPVLDYEVWGQNNDVKWCEEFITEYHELSGIWPILYISASYCGAFENSWISDKCGLWVAGYTMEYTNWIDREMPYNIYPWKFAAIWQFTSRLWDKFDGDIAYMDKKAWMKYANPNASEAKPQNPEKTIDDLAREVILGEYGTGKERKKLLGKNYDAVQKRINELFKVANDVIKGKYGNNETRKKKLKAKGYPYDTVQMIVNILMN

SEQ ID NO: 876 - protein, 270 aa, Anaerococcus prevotii
MSNSSLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDNVLNRLIDLVTDICRRNGIYPCTYTGGKDGVLQKHEWYKNTNCPGPYLGSKFPYIASEVNKRLRGNNTISKSTGGLYRVRKSWSDVKSQKGAFKNLDNAKRCADRFRLKVFNDNGKIVYPVGKTIDQLAREVINGKWGNGEERKRRLTNDGYNYYAVQRRVNELIK

SEQ ID NO: 877 - protein, 269 aa, Peptoniphilus harei
MSNSPLVQATIRSPNHSGRRNQKITKIAIHHAAGVINGRNLAGIFVPRSRKASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFSYIASEVNKRLRGNNTVSKPTGGLYRVRKSWSDVKSQKGAFKNLDNAKRCADRFRLKVFDANGKIVHPVGKSIDQLAREVIRGEWGNGEERKRRLTQAGYDYYAVQKRVNELI

SEQ ID NO: 878 - protein, 270 aa, unidentified
  REGION 1..270: note = uncultured Peptoniphilus sp.
MSNSPLVQATILSPNHSGRRNQKITKIAIHHAAGVINGRNLAGIFVPRSRRASANYNLGSDGVIVLGVDEANRAWTTSSSWCDNRAVTIEVGNSTRGPQWLVSDYVLNRLIDLVTDICRRNGIYPCTYTGGKDGVLQKHEWYKSTNCPGPYLGSKFSYIANEVNKRLSGNNTVSKPTSGLYRVRRSFSDVKSQKGAFKNLDNAKRCADRFRLKVFDANGKIVYPVGKTIDQLAREVISGKWGNGEERKRRLTNDGYNYYAVQRRVNELIK

SEQ ID NO: 879 - protein, 270 aa, Anaerococcus vaginalis
MSNSQLVQATILSPNHSGRRNQKITKIAIHHAAGVINGRNLAGIFVPRSRRASANYNLGSDGVIVLGVDEANRAWTTSSSWCDNRAVTIEVGNSMRGPQWLVSDYVLNRLIDLVTDICRRNGIYPCTYTGGKDGVLQKHEWYSNTNCPGPYLGSKFPYIANEVNKRLRGNNAVSKPTGGLYRVRKSWSDVKSQKGAFRNIENAKRCADRFGLKVFDVNGKIVYPVGKTIDQLAREVISGKWGNGEERKRRLTNDGYNYYAVQRRVNELIK

SEQ ID NO: 880 - protein, 31 aa, unidentified
  REGION 1..31: note = Collinsella sp. BG-O-102
MNGDYGNGEERKRRLGSNYAAVQRCVSQMLS

SEQ ID NO: 881 - protein, 84 aa, Streptococcus intermedius
MKIKQNNRFKIKNIELIRQLAKTSDALLQRQNKRGGGMTDYEIMIDELAREVIRGTFGNGDERKCRLGTLYDPVQKRVNEIVWR

SEQ ID NO: 882 - protein, 282 aa, unidentified
  REGION 1..282: note = Alloscardovia sp. HMSC034E08
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNVFGHRDFSATECPASIAGSQHATYMARAIYWYDQMASSKASATPAPASKPAPTGCKSIDTLAREVINGSWGNGNERYQRLTAAGFNYDAVQARVNEILGLKSKPAGKSIETLAREVIRGDWGNGRERYNRLTNAGYSYQQVQNRVNQILG

SEQ ID NO: 883 - protein, 407 aa, unidentified
  REGION 1..407: note = Caudoviricetes sp.
MKRFCKRLRQSMTAAAAAVCAIGMTAGVAMADMNGIDVSGWQPASITRAAPADFAIVKVTEGTWYTNPHWTAQANGTTTTGKALGLYHYADGGNAISEADRFVNATAAYHGKAMLVLDWEGYGNASWGSGAWVRQFVNRVHASTSVWPVVYVQRSAVWQIPSDVRQHCMLWVAQYASNASTGYQDSPWNAGASGEGMIQYTSHGVLPGYYGWLDLNRFFGDRTAWQKIACGERKGCVPTPTGIAGKPASTPPSTTGVNLDALASAVIRGEYGNNPQRRQLLGSNYDKVMAIVNRRLGVSTTPAATTPSSTRSYVVRAGDTVSAIAQRTGCLPASAWSVPSGNINLIYVGQTITYHGSTGTAVASTASGHIVRSGESLWSIYGSGWANAAARNGLYAPYTIYPGQRLR

SEQ ID NO: 884 - protein, 289 aa, unidentified
  REGION 1..289: note = Caudoviricetes sp.
MYLLKEKTTMTNWDTLEADVNRILDRHFTAGRDGNNIEFIVLHYNAGNLSIDGIWNVWQTREASAHYQVTQDGTVGQLVWDADTAWHAGNYNINTRSIGIEHANDGNGNLFPATLDNGAHLVAALCHYYGLGRPQYGENVFYHCDFYATACPGGLKNNQADEYFARAGQWYDQMAGDGSAPSPAQDYTPAQPHQTDDIDQMARDVIAGFYGNGDARRAALGANYDAVQARVNEILGFGDDGDGVDDDDYIDELARDVIAGFYGNGEDRRAALGSYYDAVQARVNEILEG

SEQ ID NO: 885 - protein, 68 aa, Bifidobacterium bifidum
MDCPWPASLSSVAAIMPKRKSTCQRIWGRFNAMARAVIRGDYGNGDERKRRLRSYYSIVQTRVNEMLS

SEQ ID NO: 886 - protein, 333 aa, unidentified; identical to SEQ ID NO: 150
  REGION 1..333: note = Candidatus Colimorpha merdihippi

SEQ ID NO: 887 - protein, 273 aa, Oscillibacter sp.
MSTVIERAIAWARAIAADAAHGYDQSSRWGPDYDCSSFVISAYRSAGLALPGATYTGNMRAVFCSCGFAWLPASTPLRAGDVLLHERNHTALYIGNGQIIHAAGNERGGATGGIPGDQTGREICVAGYYVPSYGWDGILRYTGEETPETSAPAAPSASPAEEGLYTVQSGDTLWGIAERYLGAGARWHDLYEINDLQSIDLFPGQVLRLRKDADEPPEPESAAPAAPDDEITALARAVIRGEYGNGLERVLKLGTKYRAVQAEVNRLLSGNIV

SEQ ID NO: 888 - protein, 325 aa, Bifidobacterium pseudolongum
MGYEYITKHDAACYTPGRPYGINAITIHWWDDPAVRRPSFETVINLFVTGSRQTSAHYVAEAGRVACLVAPGDRAWACGDGINVGSGGNDKSISIECNWRQSDGDYDTIAQLIADLRKTYGDLPLKPHRNWTNTDCPGTYDLARLDRLARQKAGEKLPTVSTPAKPATTPANGKLSVDQVAREVINGKWGNGADRMAKLKAAGYDAAAVQARVNEICGMSGAAGPAPAANIDAIARDVINGAYGNGADRMNRLKAAGYDPNAVQARVNQMLGANGSTQTAKPAANIDDLARRAIAGEFGNGDARRRALGANYDAVQARVNQMLGQ

SEQ ID NO: 889 - protein, 230 aa, unidentified
  REGION 1..230: note = Atopobiaceae bacterium
MSTCNPPSYPARIPPRHIHVWDRDTAWHAGNWNENCRSIGVEHANRSDGTVSEACLDAGAHLVAAISKYYGLGRREWRKNVFPHWDFQSTSCPGELGRSKKDAYMARAQAWYDSMCGGAAAPSGGASSDDTGGESISTSDIDDLARCVINGEFGNGEARRAALGERYAEVQERVNEMLGSGSSSGSTSSADIDALARAVIRGDYGNGETRKQKLGNLYSIVQKRVNEMLS

SEQ ID NO: 890 - protein, 277 aa, Solobacterium sp.
MNAKEFFERYNGQAIDDDGAYGVQCVDAFRVFCREIGIDPYPTGTGWADGYWLGREDHADVFDFIEGPQNFRNGDWVVFPRGCAAAPDSHICMYYNGKAFGQRQQDNGDRSFCLIDIDFSQAYGALRAKALEPDPAGPTESIDEIANEVIAGKWGNGTDRTNALTNAGYDANAVQARVNEIMANGSNDAHPVDIEALAQAVIAGQYGTGDDRRNALGDNYDAVQARVNEIMAQSQPSADIDELARRAIAGEFGNGDDRRAALGDLYDQVQARVNEMM

SEQ ID NO: 891 - protein, 290 aa, unidentified
  REGION 1..290: note = Atopobiaceae bacterium
MTRSSLCTYANITGNHSAGRAGNRICKITPHYMAARWSGRQCADYFASTDKEVSATYCIGTDGDIAMSVDEADRPWTSASAWNDNQAITIECANIDNGSGEMTQATWNALVALCTDICRRYGFRLEYTGNASGSLTEHRMFASTACPGAWLHGRMGQLASEVNARLDGGNAAPAAPASSSSFLAKVTVDALNIRQGPGTNYAIAGCIRDHGTYTIVETNRNWGRLKSGAGWICLDYTNRNGYAVPTPAPVDLDALARDVITGKYGNGDDRKRALGANYAAVQQRVNEMLS

SEQ ID NO: 892 - protein, 325 aa, Bifidobacterium pseudolongum
MGYEYITKYDAACYTPGRPYGINAITIHWWDDPSVRRPSFDTVINLFVSGSRKTSAHYVAEAGRVACLVAPGDRAWACGDGINVGSGGNDKSISIECNWRQSDGDYDTIAQLIADLRKTYGDLPLKSHCTWTSTDCPGTYDLARLDRLARQRAGEKLPTVSTPAKPATTPAGGKLSVDQVAREVINGKWGNGADRMAKLKAAGYDAAAVQARVNEICGMSGAAGPAPAANIDAIARDVINGAYGNGADRMNRLKGAGYDPNAVQARVNQMLGAGGSTQTTKPAVNIDDLARRAIAGEFGNGDARRRALGANYDAVQARVNQMLGQ

SEQ ID NO: 893 - protein, 246 aa, Clostridium sp.; identical to SEQ ID NO: 158

SEQ ID NO: 894 - protein, 87 aa, Actinomyces sp.
MRSYCKQRIDEKADMVLRGYYGDDEYRRRTLGADYDAVQQRVNQIIDDYARDVMRGRYGNGRERQRRLGHLYPAVQARVNEVLRGNW

SEQ ID NO: 895 - protein, 334 aa, Collinsella sp.
MAYGHGAFVVRRSMKNKKMTVWLAVLAVAMALATPAQAYESREAIVSQGHGACSPTFLAVHETGNAGASATNHVTYWRRTASWVCMTHYVMELDGSAVYHTQPDNTVAWHVGNGNSRCVGIELTHATDRRTFERQWDEAVAWCADYLHGRGWGIGQLVSHQDCSRRWGGSDHTDPDGYFAVYGRSWEQFKTAVAGRMNAQATGGHDSGFAGGTYRCTVHALNLRTAPSLSGRVTGTLREGETVLLDSWYTIADGWIWGRLHRGGTTLYAAVGKPTGKPEANDYLVLAGDGVASYDVDALARAVIRGEYGTGAARRNALGDRYEVVQRRVNQMLS

SEQ ID NO: 896 - protein, 321 aa, Collinsella sp.
MKNKKLTVWLAVLAVAMALATPAQAYESREAIVSQGHGACSPTFLAVHETGNAGASAANHVTYWRRTASWVCMTHYVMELDGSVVYHTQPDNTVAWHVGNGNSRCVGIELTHATDRRTFERQWDEAVAWCADYLHGRGWGIGQLVSHQDCSRRWGGSDHTDPDGYFAVYGRSWEQFKTAVAGRMNAQATGGHDSGFAGGTYRCTVPALNLRTAPSLSGRVTGTLREGETVLLDSWYTTADGWIWGRLHRGGTTLYAAVGKPTGKPEANDYLVLAGDGVASYDVDALARAVIRGEYGTGAARRNALGDRYEVVQRRVNQMLS

SEQ ID NO: 897 - protein, 334 aa, Collinsella sp.
MAYGHGAFVVRRSMKNKKLTVWLAVLAVAMALATPAQAYESREAIVSQGHGACSPTFLAVHETGNAGASAANHVTYWRRTASWVCMTHYVMELDGSAVYHTQPDNTVAWHVGNGNSRCVGIELTHATDRRTFERQWDEAVAWCADYLHGRGWGIGQLVSHQDCSRRWGGSDHTDPDGYFAVYGRSWEQFKTAVAGRMNAQATGGHDSVFAGGTYRCTVPALNLRTAPSLSGRVTGTLREGETVLLDSWYTTADGWIWGRLHRGGTTLYAAVGKPTGKPEANDYLVLAGDGVASYDVDALARAVIRGEYGTGAARRNALGDRYEVVQRRVNQMLG

SEQ ID NO: 898 - protein, 327 aa, unidentified
  REGION 1..327: note = Atopobiaceae bacterium
MDFDNLNADVNMIISQHYTQGRGGHAIDKVVIHHNAGNLSVEDCCRVWESREASAHYQVQSDGRIGQLVWDSDTAWHCGDFEQNQRSIGIEHADDSSSPWHISDACLDAGAHLVAAVCRYYDLGRPEWGRNLFGHSDFAATACTASLAVGGSQHDEYVARAQQWYDAMAGGTGAPAAPVSQPEAQPSAPGGSVDELAQRVIAGDFGTGDERRAALGSRYDEVQDRVNEILSGGSQASGAPDIDGLARRTLNGEFGNGDQRKSALGSLYDAVQQRVNELCGQGSSGGADIDDLARRAINGEFGNGDERRSALGDLYDAVQARVNEMLS

SEQ ID NO: 899 - protein, 321 aa, unidentified
  REGION 1..321: note = Coriobacteriales bacterium
MKNKKLTVWLAVLAVAMALATPAQAYESREAIVSQGHGACSPTFLAVHETGNAGASAANHVTYWRRTASWVCMTHYVMELDGSAVYHTQPDNTVAWHVGNGNSRCVGIELTHATDRRTFERQWDEAVAWCADYLHGRGWGIGQLVSHQDCSRRWGGSDHTDPDGYFAVYGRSWEQFKTAVAGRMNAQATGGHDSGFAGGTYRCTVPALNLRTAPSLSGRVTGTLREGETVLLDSWYTTADGWIWGRLHRGGTTLYAAVGKPTGKPEANDYLVLAGDGVASYDVDALARAVIRGEYGTGAARRNALGDRYEVVQRRVNQMLG

SEQ ID NO: 900 - protein, 327 aa, Bifidobacterium longum
MKNWETLEADEDMILNTHFTPGRSGRNIDKIVIHHNAGNLSIAGCYNVWQTREASAHYQVDSNGRIGQLVWDADTAWHAGDWAANTTSIGIEHADINTNPWQCSDATIDNGAHLVAALCKYYELGRPQWGVNVFPHSRFSATECPASLAGTQNAAYMAKAQYWYDKMSGGNPSTPSTPSQPQQHATNLEALAAAVIRGDYGNGDERKQRLGSQYDAVMAIVNARYGIASGGSSASVNIDDLARRVINGEFGVGDARKAALGSNYEAVQARVNQLLGQGGGGSAPSVDLNALADAVIRGDYGNGAQRQAALGANYAAVQAIVNKKLGY

SEQ ID NO: 901 - protein, 160 aa, Eggerthella lenta
MLAEFSISETGGIDGEPGDQTGRESWVHDYYSGRWDGILHYNGKADVGSASTPTGSGAPSGDVSELAARVIAGDFGNGDARRAALGSRYDEVQAEVNRILSGGSSSGSYDVDALARRVIAGEFGNGDDRKRRLGDKYSAVQKRVNEILGALGASSTSMDV

SEQ ID NO: 902 - protein, 153 aa, Eggerthella lenta
MLAEFSISETGGIDGEPGDQTGRESWVHDYYSGRWDGILHYNGKADVGSASTPTGSGAPSGDVSELAARVIAGDFGNGDARRAALGSRYDEVQAEVNRILSGGSSSGSYDVDALARRVIAGEFGNGDDRKRRLGDKYSAVQKRVNEILGALGA

SEQ ID NO: 903 - protein, 73 aa, unidentified
  REGION 1..73: note = Actinomyces sp. HMSC065F11
MVLRGYYGDDEYRRRTLGADYDAVQQRVNQIIDDYARDVMRGRYGNGRERQRRLGHLYPAVQARVNEVLRGNW

SEQ ID NO: 904 - protein, 292 aa, unidentified
  REGION 1..292: note = Bacteriophage sp.
MKGIDISCWQEKVNYLELKAQGIDFAIIRCGFGKNISQKDSKFEDHYAGLKYAGIKIGAYLYSYANTIEGAKSEAKNCLEFIKNKKFDLPIFYDLEDAKTTGNASKETITEMAKVFCEEIIKEGYQAGVYANLNWFTNKINVNELEKYNIWLAQWGVDKHTADFKVDIWQYTSKGKIKGINGNVDLDISYTQYGDKYVNNSKSIEELARAVIRGEYGNGQERKDRLGNLYNEVQARVNKILLGNNVSQETPNIEELARAVIRGEYGNGQERKNKLGNLYNEVQKRVNEILRG

SEQ ID NO: 905 - protein, 255 aa, unidentified; identical to SEQ ID NO: 39
  REGION 1..255: note = Propionimicrobium lymphophilum

SEQ ID NO: 906 - protein, 481 aa, Streptococcus agalactiae
MAINIETAIAWMSSRAGKVTYSMDYRNGPGSYDCSSSVYYALMSAGALTAGWAVNTEYQHDWLIKNGYKLIAENQDWNAKRGDVFIWGRRGQSSGAGGHTGIFVDPDNIIHCNYARNGITVNNYNQTAAASGWMYCYVYRLANQSSTSTTGKSLDTLVKETLAGVYGNGDTRKAALGNQYEAVMAVINGKVTTLKKTIDQLAKEVIAGKHGNGDERKKSLGSNYDAVQKRVTEMLKGGTSSNAPKTPTDKPKSDVVNSITTPKKEETGATGKATDTKITKEDGDLSFNGAILKKSVLDVILSKCKEYNILPSYAITVLHFEGLWGTSAVGKADNNWGGMTWTGKGERPSGVTVTQGIARPSNEGGHYMHYSSVDDFLTDWFYLLRANGSYKVSGAKTFSDAIKGMFKVGGAVYDYAASGYDNYLVGMSSRLKSIEAENGSLDKFDKLTVTDVGQSDKIEVNIEGVEISINGVTYTISKKPV

SEQ ID NO: 907 - protein, 270 aa, Varibaculum cambriense
MNFETLQADINLPMNKHYTKGRGGHKIDKILVHHNSGRLTTRGCWETWQTRQASAHYQVEESGRIGQLVWDRDTAWHAGNWRANQTSIGIEHANNDTKHWTISPATLEAGAHLVAALCKAYKLGRPEWLKNVYPHQYFANTDCPGQIAHSQRAAYMERAQYWYDIMTGTHPAPASPAPSVDLEALASAVIAGKYGNGEARRRALGANYAAVQAIVNRRLTGKSAPAPSVDLEALASAVIAGKYGNGETRRRALGSNYAAVQAIVNRRLLG

SEQ ID NO: 908 - protein, 481 aa, Streptococcus hyovaginalis
MAINIETAIAWMSSRAGKVTYSMDYRNGPGSYDCSSSVYYALMSAGAITAGWAVDTEYQHDWLIKNGYKLIAENQDWNAKRGDVFIWGRRGQSSGAGGHTGIFVDPDNIIHCNYARNGITVNNYNQTAAASGWMYCYVYRLANQPTTSPSGKNLDTLVKETLAGKYGNGDNRKAALGNQYEAVMAVINGKVTTPKKTIDQLAKEVIAGKHGNGDERKKSLGSNYDAVQKRVTEMLKGGTSSNAPKTPTDKPKSDVVNSITTPKKEETGATDKATDTKMTKEDGDLSFNGAILKKSVLDVILAKCKEHNILPSYAITVLHFEGLWGTSAVGKADNNWGGMTWTGKGERPSGVTVTQGTARPSNEGGHYMHYLSVDDFLTDWFYLLRANGSYKVSGAKTFVDAIKGMFKVGGAVYDYAASGYDNYLVGMSSRLKSIEAENGSLDKFDKLTVTDVGQSDKIEVNIEGVEISINGVTYTISKKPV

SEQ ID NO: 909 - protein, 258 aa, unidentified
  REGION 1..258: note = Bifidobacterium
MSHTYTLNHRQAACFTPGRGGNRITTIVIHHWDDPAKNPTFDGTVGWFVSGRGRNSAHYVVEAGRVTRLVAESDTAWHAGNWPVNQTSIGIECNPRASEADKQTIAALIRDIQSRHGKLRIIGHKDASSTACPGRYYPPATVLAPYLGGNSGVPAAPKPPAASAPGGSVDELARAVLAGRYGNGEERKRRLGSRYAEVQRRVNELIAGKAPAPAAPDLDALANAVLRGEYGNGEERRRRLGHLYQPVQDLVNRKLGIR

SEQ ID NO: 910 - protein, 347 aa, unidentified; identical to SEQ ID NO: 146
  REGION 1..347: note = Lederbergia galactosidilytica

SEQ ID NO: 911 - protein, 87 aa, unidentified
  REGION 1..87: note = Actinomyces sp. HMSC065F11
MRSYSKQRIDEKADMVLRGYYGDDEYRRRTLGADYDAVQQRVNQIIDDYARDVMRGRYGNGRERQRRLGHLYPAVQARVNEVLRGNW

SEQ ID NO: 912 - protein, 356 aa, Aeriscardovia aeriphila
MSLNGIDISNWQAGLDPVAVPGDFIIVKASEGVDYISPVFRRQTDGTLNSGKLLGVYHYLNGSGAAAEAAFFVTQAQPYLGRAVLALDWEKQGNSEFGNVEYLRQVAAEVIRLTGVRPLIYCSSSLLSSVAPVAQELNCGLWVAQYPNYERTGYQQSPWNEGAYACAIRQYSSSGLLNGYQGNLDLDKFYGDKNAWLKYAAVNGKPAATPAPTQPAGQKSISDIATEVIAGKWSTGTERIRRLQAAGYNYQQVQDEVNRRLNPAPNLEALANAVIAGKYGNGQERKNRLGANYDAVMAIVNKKLGANRVTPRVYVVKPGDSLSSIGVRLGVSWAKLARDNGIANPNVIYPGQRLTY

SEQ ID NO: 913 - protein, 322 aa, unidentified; identical to SEQ ID NO: 164
  REGION 1..322: note = Anaerolactibacter massiliensis

SEQ ID NO: 914 - protein, 111 aa, Actinomyces bovis
MVSEDPIADTVAAAASNVPAAAEATAPQAPAVIPMEALIPQPAAAVEETVPSAPATDGAPVVEEAAPAETPDIEALAHAVIRGDYGNGEDRRAALGDLYDQVQARVDEILS

SEQ ID NO: 915 - protein, 325 aa, Bifidobacterium pseudolongum
MSDYNYLTQYDAACFTPGRPYSIDAITIHWWDDPSVRRPSFDTVINLFVTGSRQTSAHYVAEAGRVACLVAPGDRAWACGDGINVGSGGNDKSISIECNWRQSDGDYDTIAQLIADLRKTYGDLPLKPHRNWTNTDCPGTYDLARLDRLARQKAGEKLPTVSTPAKPATTPAGGKLTVDQVAREVINGKWGNGADRMAKLKAAGYDAAAVQARVNEICGMSGAAGPAPAVNIDAIARDVINGAYGNGQERMAKLKAAGYDAAAVQARVNQMLGVGGTQTTKPAANIDDLARRAIAGEFGNGDARRRALGANYDAVQARVNQMLGQ

SEQ ID NO: 916 - protein, 321 aa, Collinsella aerofaciens
MKNNKLAVWFAVLAVTMALATPAQAYESREAIVSQGHGACSPTYLAVHETGNAGASAANHVTYWRRTASWVCMTHYVMELDGSAVYHTQPDNTVAWHVGNDNSLCVGIELTHATDHAIFERQWDEAVSWCADYLRGRGWGIGQLVSHRDCSLRWGGSDHTDPDGYFAAYERSWAQFKTAVAIHMNAQASGSHDGGFAGGRYRCTVSALNLRTAPSLSGRVAGTLRKGEAVLLDFWYTTADGWIWGRLHRGGTTLYVAVGKPTGKPEANDYLVLAGAGVASYDVDALARAVIRGEYGTGAARRNVLGDRYETVQRRVNQMLG

SEQ ID NO: 917 - protein, 413 aa, Bifidobacterium dentium
MKPLFKKFRKAVCATISTLCIGGMTAGVALADMNGIDVSGWQTPDITAVVPADFAIVKVNQGTWLNGSWQTQAANAVNTGKELGLYDYASGVNATAEADAFVNNVGGYVGKAMLVLDWESYQNSAFGNSSWIREWVNRVHERTSVWPVVYCSKSVVSQIPSDVRQHCMLWAAQYANNHATGYQSSPWNAGSSGEGMLQYSSSGYLNGRGPLDLDVFFGDRVAWRKIACGERQGCSTSGTGSTGTASKPTTTTKTETTTTTTDLNALASAVIRGEYGNGQDRRNRLGGNYDKVMAIVNSRLTGSTYTGSTTVTRTVTRTYVVRSGDTVSAVANRLGLLPVSAWRVPSGNLNRIYVGQTITYIGSATTSTTSYSSSHVVRAGESLWSIYGTGWASAAARNGLRYPYTIYPGQTLR

SEQ ID NO: 918 - protein, 50 aa, unidentified
  REGION 1..50: note = Actinomyces trachealis
MTGESVPSGDLDSLASRVIAGEFGNGDERKRRLGTNYAAVQAIVNRKLGY

SEQ ID NO: 919 - protein, 317 aa, unidentified; identical to SEQ ID NO: 154
  REGION 1..317: note = Oceanobacillus sp. J11TS1

SEQ ID NO: 920 - protein, 189 aa, unidentified
  REGION 1..189: note = Bifidobacterium sp. SO1
MLVTSAMLIAAISVAPAPQAPVASVDVDATAIAVVRGDYGTGEERRARLGADYDVVQSRVNELLDAVGYTVDYVEPETVAPAVVPEPVQTEPVPVETVSEPPAVESVQTEAEQVGPQSYTVEDIYDLAMSEDMPMCMLEDGSDRPMCYWHDENTGIDSPSVDIVYMPDGYGYQVTGDTTVSVFQRNTWE

SEQ ID NO: 921 - protein, 318 aa, unidentified
  REGION 1..318: note = Adlercreutzia caecimuris
MTVFISQASCDERGKYVGGQAGNQSGTELNTRAYYSNSSNPWVTYRAKDTATAKKIADAAAQAVANMHIGYDQYERNTIRTQAKAVSWVLAAISKNCECDCTSLAATCCICAGLSDDALFKGGNLMYTGDAATKLTNAGMQRIGAGLAESALRLGDVLVRDGHCVVVTSAPTQSGAHVAPTTAVSGSIDELARAVIAGRFGNGESRRAALGGKYDAVQARVNELLSGTPNAAGTSTGSARIIAGTYKVVASSLNVRSAPSLGAEVVASYSYGETINSIAADITEKDGYTWAHYTGYSGATRYVAIGTSDGSEKYLVKC

SEQ ID NO: 922 - protein, 316 aa, Collinsella aerofaciens
MAVWFAVLAVTMALATPAQAYESREAIVSQGHGACSPTYLAVHETGNAGASAANHVTYWRRTASWVCMTHYVMELDGSAVYHTQPDNTVAWHVGNDNSLCVGIELTHATDHAIFERQWDEAVSWCADYLRGRGWGIGQLVSHRDCSLRWGGSDHTDPDGYFAAYERSWAQFKTAVAIHMNAQASGSHDGGFAGGRYRCTVSALNLRTAPSLSGRVAGTLRKGEAVLLDFWYTTADGWIWGRLHRGGTTLYVAVGKPTGKPEANDYLVLAGAGVASYDVDALARAVIRGEYGTGAARRNVLGDRYETVQRRVNQMLG

SEQ ID NO: 923 - protein, 87 aa, unidentified
  REGION 1..87: note = Gleimia europaea
MRSYSKQRIDEKADMVLRGYYGDDEYRRRTLGADYDAVQQRVNQIIDDYARDVMRGRYGNGRERQRRLGHLYPAVQARVNEVLRGDW

SEQ ID NO: 924 - protein, 39 aa, unidentified
  REGION 1..39: note = Paratractidigestivibacter faecalis
MASLARRVINGDYGNGEERKRRLSSNYAAVQRRVNQMLS

SEQ ID NO: 925 - protein, 326 aa, Bifidobacterium pseudolongum
MSDYNYLTQYDAACFTPGRPYGIDAITIHWWDDPSVRRPSFDAVINLFVTGSRKTSAHYVAEAGRVACLVAPGDRAWACGDGINVGSGGNDKSISIECNWRQSDGDYDTIAQLIADLRKTYGDLPLKPHRTWTSTDCPGTYDLARLDRLARQKAGEKLPTVSTPAKPTAKPTVGKLTVDQVAREVINGTWGNGADRMAKLKAAGYDAAAVQARVNEICGMSGAAGPAPAANIDAIARDVINGAYGNGQDRMTRLKVAGYDPNAVQARVNQMLGANGSTQTTKPAVNIDDLARRAIAGEFGNGDARRRALGANYDAVQARVNQMLGQ

SEQ ID NO: 926 - protein, 216 aa, unidentified
  REGION 1..216: note = uncultured Ellagibacter sp.
MGHSILFKQCGSDHMTRGRSHAIDRIVIHYAATLASARNNAIYYSRNERQGSSAHYFVDDITDEIYQSVAEGDTAWHAGNWLMNCRSVSIEVVSAGEDYSEVEVGKLAWLGQTLMKRYGISEGGVIRHYDVTGKVCPAPYIAAGCWAALRSRICRGIASSGTTAAESSGSSSAPSGNVASLARRVINGEFGNGEARKRRLGSNYAAVQRRVNQVLS

SEQ ID NO: 927 - protein, 87 aa, unidentified
  REGION 1..87: note = Actinotignum urinale
MADAVLRGEYGNGADRRARLGGLYDTVQAVVNQKLGATGNTRGAGVDINALADGVLKGLYGNGAERRQRLGVHYDAVQAEVNRRLGY

SEQ ID NO: 928 - protein, 197 aa, Eggerthella lenta
SGLFSWKPISFNAQRGDIYLDESAHTAMCVRNDGTADLLAEFSISETGGIDGEPGDQTGRESWVHDYYSGRWDGILHYNGKADVGSASTPTGSGAPSGDVSELAARVIAGDFGNGDARRAALGSRYDEVQAEVNRILSGGSSSGSYDVDALARRVIAGEFGNGDDRKRRLGDKYSAVQKRVNEILGALGASSTSMDV

SEQ ID NO: 929 - protein, 188 aa, Eggerthella lenta
LFSWKPISFNAQRGDIYLDESAHTAMCVRNDGTADLLAEFSISETGGIDGEPGDQTGRESWVHDYYSGRWDGILHYNGKADVGSASTPTGSGAPSGDVSELAARVIAGDFGNGDARRAALGSRYDEVQAEVNRILSGGSSSGSYDVDALARRVIAGEFGNGDDRKRRLGDKYSAVQKRVNEILGALGA

SEQ ID NO: 930 - protein, 248 aa, Trueperella pyogenes
MGYSYSFDPASPANYTVGRGGKRITTIVIHHWDDPAKNPQLGGVVTTFKNPGRGASAHYVVEAGRVVQMVDLANTAWHAGNWPVNQCSIGIECNPRCSEADKATIGELIRDLQAKYGPLRIIGHKDASSTACPGRYYPPASVLAPYIGGGGSVPAPTPAVSGDVDELAHRVIAGEFGNGEERKTRLGSQYGAVQARVNEILAGRPAQPNPAAPATPAPAADIEALADAVIRGEYGNGNDRKARLGQLY

SEQ ID NO: 931 - protein, 290 aa, unidentified
  REGION 1..290: note = Bacteriophage sp.
MQRVIDVSYHNGKVNWELVKAAGYHAILRAGYGTDRADQDDAEFRRNADACERLAIPWGAYLYSYADNATRAMSEAAHMIRLMEPYKDARYRLYPCFFDAEQAGTEDTAADNAVIWCRQLAAEGYDTGIYANEHWWSTILKHVSADCRWVAKWSSRAPSVAWDIWQCTDRADVPGCTGNGGRTDLSQSKLDISAPPIYEGPEGPGDMTVDELADAVERGDYGNGEDRRRALGGKYDVVQLIVNLRNGSTAGISKVADDVIADRYGKGEARKIALGSAYKPVQKLVNKKLK

SEQ ID NO: 932 - protein, 290 aa, unidentified
  REGION 1..290: note = Bacteriophage sp.
MQQIIDVSYHNGKINWELVKAAGYHAILRAGYGTDRADQDDAEFRRNADACERLGIPWGAYLYSYADNTTRVMSEAAHMIRLMEPYKDARYRLYPCFFDAEQDGTEGTAAANAVLWCRKLAAEGYDTGVYANEHWWSTILKHVSAECRWVAKWSSRAPSVAWDIWQCTDRADVPGCTGNGGRTDLSQSKLDISAPSVCEGPEGPGDMTVDELADAVERGDYGNGEDRRRALGGKYDVVQLIVNLRNGSTAGLSKVADDVIADRYGRGEARKIALGSAYKPVQKLVNKKLK

SEQ ID NO: 933 - protein, 294 aa, unidentified
  REGION 1..294: note = Ruminiclostridium sp.
MLKGIDVSNWQAGLIPSSLDIDFCIAKATEGIGYTDHTCDGFVQNCIDNGIPFGFYHFARENDPASEADYFVQETRNYFGRGIPVLDYETENFNNCVWCEQFMVRVHELTGVWPVLYISASHCSQYNGSWLPETCGLWVAGYPAAFDNWYEGEIPYDISPWSFCAMWQFTSSLQLAGYAGNLDGNIAYMDKEAWMKYANVHGSSVQPAQPAQPEKSDDDLACEVILGEYGTGEDRKRMLGSRYDAVQARVNQYVERAQECIRGDWGNGWNRKTALEGAGYDPDIVQRLVNDMMN

SEQ ID NO: 934 - protein, 132 aa, Collinsella intestinalis
MNCRSIGIEIISADEDFSEAAIAKAVWLTRCLQEKYDIPDANVIRHYEVTGKRCPAPSIEASRWSRLKARLCGDGTLTGQGSGAGSGPAPTGSAQELACRVIAGEFGNGAERRRRLSANYNAAQHRVNDLLS

SEQ ID NO: 935 - protein, 326 aa, unidentified
  REGION 1..326: note = Arthrobacter phage Zeina
MTFSPLASGTIPHHNKFSNRNGSPIIRVLQHHHAATGLAGVERLTDPNQQASANYVILSTGQILGQVPEEYRAWTSGSFEADAPSITYEVQNAGGQVNGNDDDPKSWIITQAAEAAIVRLTADIAKRYKWGGVSAANYRGHREFYQTACPGGYLWNRMGIIRSNANAMVVGKVPTGTPAPVHPPVQAKSIWTLAQETIKGVYGSGDARKRALGSKYDAVQAEVNRILGAPKAALPAKKSIAQLADETIAGVYGSGAVRQQKLGANYAAVQAEVNRRLGAARPTGPSISQLADAVIRGDYGSGDMRKARLGSLYAAVQAEVNRRYGA

SEQ ID NO: 936 - protein, 326 aa, unidentified
  REGION 1..326: note = Arthrobacter phage GantcherGoblin
MTFSPLASGTIPHHNKFSNRNGSPIIRVLQHHHAATGLAGVERLTDPNQQASANYVILSTGQILGQVPEEYRAWTSGSFEADAPSITYEVQNAGGQVNGNDDDPKSWIITQAAEAAIVRLTADIAKRYKWGGVSAANYRGHREFYQTACPGGYIWNRMGIIRSNANAMVVGKVPTGTPAPVHPPVQAKSIWTLAQETIKGVYGSGDVRKRALGSKYDAVQAEVNRILGAPKAALPAKKSIAQLADETIAGVYGSGAVRQQKLGANYAAVQAEVNRRLGAARPTGPSISQLADAVIRGDYGSGDMRKARLGSLYAAVQAEVNRRYGA

SEQ ID NO: 937 - protein, 326 aa, unidentified
  REGION 1..326: note = Arthrobacter phage Uzumaki
MTFSPLASGTIPHHNKFSNRNGSPIIRVLQHHHAATGLAGVERLTDPNQQASANYVILSTGQILGQVPEEYRAWTSGSFEADAPSITYEVQNAGGQVNGNDDDPKSWIITQAAEAAIVRLTADIAKRYKWGGVSAANYRGHREFYQTACPGGYIWNRMGIIRSNANAMVVGKVPTGTPAPVHPPVQAKSIWTLAQETIKGVYGSGDARKRALGSKYDAVQAEVNRILGAPKAALPAKKSIAQLADETIAGVYGSGAVRQQKLGANYAAVQAEVNRRLGAARPTGPSISQLADAVIRGDYGSGDMRKARLGSLYAAVQAEVNRRYGA

SEQ ID NO: 938 - protein, 326 aa, unidentified
  REGION 1..326: note = Arthrobacter phage Lewando
MTFSSLIAGTVPHHNKFSNRNGQPIVRVLQHHHAASSLAGLTRLTDPNQQASANYVILSTGQIFGQVPEEYRAWTSGSFEADAPSITYEVQNSGGQVNGNDDDPKSWTITPAAEAAIVRLTADIAKRYRWGGVAAGNYRGHREFYQTACPGGYIWNRMSLIRANANAMAVGKVPSGTPAPAHPPVAAKSIWTLAQETIKGIYGSGDARKKALGSKYDAVQAEVNRILGAPKAALPKVKSIAQLADETIAGVYGSGAVRQQKLGANYAAVQAEVNRRLGAARPTGPSISQLADAVIRGEYGEGDMRKARLGGLYAAVQAEVNRRYGA

SEQ ID NO: 939 - protein, 326 aa, unidentified
  REGION 1..326: note = Arthrobacter phage Argan
MTFSPLASGTIPHHNKFSNRNGSPIIRVLQHHHAATGLAGVERLTDPNQQASANYVILSTGQILGQVPEEYRAWTSGSFEADAPSITYEVQNAGGQVNGNDDDPKSWIITQAAEAAIVRLTADIAKRYKWGGVSAANYRGHREFYQTACPGGYIWNRMGIIRSNANAMVVGKVPTGTPAPVHPPVQAKSIWTLAQETIKGVYGSGDARKRALGSKYDAVQAEVNRILGAPKAALPAKKSIAQLADETIAGVYGSGTVRQQKLGANYAAVQAEVNRRLGAARPTGPSISQLADAVIRGDYGSGDMRKARLGSLYAAVQAEVNRRYGA

SEQ ID NO: 940 - protein, 36 aa, unidentified
  REGION 1..36: note = Ellagibacter isourolithinifaciens
MARAMICGDYGNGDERKRRLGSYYSIVQARVNEMLS

SEQ ID NO: 941 - protein, 176 aa, unidentified
  REGION 1..176: note = Prevotellaceae bacterium
MVELKRKVTLKPKGAAQEPPPPGKSNKKWWLWSLLAVVVVAAVIFVWQNSNGGKDDPSGEQTAAEQSPATETATEDAASTGESTPAETPKPESGDNGQADTSTASPAETKPAEQSAAPAQSAQPKAETLTGTLEEKAKRVIRGEFGNGAERKRRLGTAYSEIQRKVNEMYRNGEVY

SEQ ID NO: 942 - protein, 244 aa, unidentified
  REGION 1..244: note = Bacteroidales bacterium
MAQLKQKVKLKQKQEIEKISPKPKPKWWLWLSLVVVGIIGIVLIVKNYSSDKTDKNLIAKTEQATVKANEIIAEVQSGNVNYEDAKAKVTEAQNIVNEAKADAKTEDEKKAVVEAQAKVDEAAKTVEASKPSTQPLETEEPLTLEQGEGVASTTPDETSTPNQATGEKPDANTSNDSKPPTNDQNTNATLTPAVSVSEGTLEQKAKEVIRGDYGNGAERKRALGSEYDEIQGKVNEMYRKGEVR

SEQ ID NO: 943 - protein, 154 aa, unidentified
  REGION 1..154: note = Muribaculaceae bacterium
MSKEKIFKPEDFDKTIDKSFWRKHKGKILCSAAILIVAAIVVCYIFCWKEEQEKKINKEHYEQVSKNPDTTYDKTITNKVEPGTTEEPQDVVNVDSLTIPEPTQLTVISANVEQEAMNVIRGDYGNVPERRQKLGSKYREIQDRVNELKRQGAF

SEQ ID NO: 944 - protein, 373 aa, unidentified
  REGION 1..373: note = Caudoviricetes sp.
MTLKRDIMFLNGIDISNWQARIDLAAVPADFVIAKATQGTGYVSPDCARQVEQARQVGKRFGVYHYVSGGNAVAEANYFVDNCANWVGKGLFCIDWESNENSAWGNEGYLEQVVAQVKARTGIPPIIYVQASRYAQVAPVAKRQNCGLWIAQYANMNPTGYQNTPWNEGAYTCVIRQYSSTGRLPGYGGNLDLNKFYGDGATYDKYVTGGGNTSNVPPSPPADPLAGRSDDDLANAVIRGEFGDGDARRQKLGGRYDAVQALVNRKLAKPQSSGRTYTVQPGDTLSGIAAKLGVAQSQISGFHSGNPNLIYPGEVLSVSGGSPQHSAEYYTVQSGDNLSAIAARYGTSWQHIRDLNGLANPNLIYPGQRLRVK

SEQ ID NO: 945 - protein, 287 aa, unidentified
  REGION 1..287: note = Caudoviricetes sp.
MVEKMNETLMSDSGRLVNLEFVVIHNDAGSMTPKQYIDWLRYRDKALGIAHYYCNRDCIARVVDTFNIGYHTGDWWSNCRSIGYEVCESMKVSDTEFLQNEDVTLMQATEDLLFYGLPITTQTVRLHHEFVPTTCPHRSMELHGGSTESVKKYFVDRMNYFATLGSTVEEMMGQYNGEVTVEEVTPKENALKSDETVANEVLQGLWGNGNERIELLTDAGYDAQKIQRIVNQLVLGEDDEDIVDIDEVAQEVIQGEWGNGDERRVRLEDAGYNYQAVQDRVNELLGE

SEQ ID NO: 946 - protein, 399 aa, unidentified
  REGION 1..399: note = Bifidobacterium amazonense
MPKLKKQLMAVSGILLAACLAVPLAIADMRGIDVSGWQSPTVTCTADYDFAVVKATQGTGFTNGYMTSQTRCVQQRGKSLGFYHYAGGGNATAEADYFVNTVRPYVGKAVLVLDWEGYQNAAWGNSNWVRVFVNRVHDRTGVWPLVYTSAAYLYQIPADVRSRCGLWVAQYASNAATGYQSRPWNYGKYGEAMRQYTSNGWINGYNGPLDLNYFRGTREQWNKYANPSGNASAPSPAPQPSTPSVDYEALATAVIRGDYGNGDARRAALGVNYDRVMRIVNQRLGGSTTSAPAPAMKTVSVVVRSGDTMSGIATRTGLWPLSAWRVPSGNVNLIYPGNVVTYRGASSSTGSAATTVRVHVVKSGETLSGIFGASGWQRVAQLNGLANPNLIYPGQLLRY

SEQ ID NO: 947 - protein, 287 aa, unidentified
  REGION 1..287: note = uncultured Granulicatella sp.
MVEKINETLMSDSGRLVNLEFVVIHNDAGSMTPKQYIDWLRYRDKDLGIAHYYCNRDCIARVVDTFNIGYHTGDWWSNCRSIGYEVCESMKVSDTEFLQNEDVTLMQVTEDLLFYGLPITTQTVRLHHEFVPTTCPHRSMELHGGSTESVKKYFVDRMNYFATLGSTVEEMMEQFNGEVVVEKVTPKENALKSDETVANEVLQGVWGNGNERIELLTDAGYDAQKIQSIVNRLLLGEDDEDVVDIDEVAQEVIQGEWGNGDERRVRLENAGYNYQAVQDRVNELLGE

SEQ ID NO: 948 - protein, 316 aa, Bifidobacterium catenulatum
MKNWNTLEADENLILNTHYTPGRSGGSVKYVVVHHNAGNLTAQQIYNVWQTREASAHYQVAADGKISQHVWDSDTAWACGNWDANTNSISVEHADISTSPWTISDATLDNGAHLVAALCKYYKLGRPQWNVNVFPHSHFSGTQCPASIAGSQNAAYMAKAQYWYDKMCGANPSAPSTPSQPQQHATNLEALADAVIRGDYGNGDQRRNALGANYDAVMAIVNQRYGITGGNGGNAGTNIDDLARRAINGEFGNGDQRRAALGSNYDAVQARVNQMLGQGGGSAPSVDLNALADAVIRGDYGNGDQRRNALGANYDA

SEQ ID NO: 949 - protein, 315 aa, Bifidobacterium catenulatum
MKNWNTLEADENLILNTHYTPGRSGGSVKYVVVHHNAGNLTAQQIYNVWQTREASAHYQVAADGKISQHVWDSDTAWACGNWDANTNSISVEHADISTSPWTISDATLDNGAHLVAALCKYYKLGRPQWNVNVFPHSHFSGTQCPASIAGSQNAAYMAKAQYWYDKMCGANPSAPSTPSQPQQHATNLEALADAVIRGDYGNGDQRRNALGANYDAVMAIVNQRYGITGGNGGNAGTNIDDLARRAINGEFGNGDQRRAALGSNYDAVQARVNQMLGQGGGSAPSVDLNALADAVIRGDYGNGDQRRNALGANYD

SEQ ID NO: 950 - protein, 374 aa, unidentified
  REGION 1..374: note = Arthrobacter phage Niktson
MTFSSLISGTIPHNNKFSSRQGIPVSRIIQHHFAGSSDGRLRSATEQASSHYIIYNDGSIWGLVPEEYRAWTSGSFEADAPSITYEVQNSSFQINGNDNDPNSWAVSNAAYDAIVRLTADIARRYGFGAVTPTNYQGHRQWYATSCPGGFLWARMDNTRSLANKNLSGATVPTPTPSTPPVAGKTVWQLADEVLAGHHGSGDARKISLGNQYDAVQAEINRRFGVGVAAPAAKTVSQLADEVLAGAHGNGEQRRASLGNMYDAVQNEINRRVGGGGVAPQGVNISQLADAVMRGEYGSGQDRVNRLGANYAAVQAEVNRRFGGGVAVAAPTLAVNISALADAVLRGEYGNGDDRVRLLGANYAAVQAEINRRYA

SEQ ID NO: 951 - protein, 374 aa, unidentified
  REGION 1..374: note = Arthrobacter phage Breylor17
MTFSSLISGTIPHNNKFSSRQGVPVSRIIQHHFAGSSDGRLRSATEQASSHYVIYNDGSIWGLVPEEYRAWTSGSFEADAPSITYEVQNSSFQINGNDNDPNSWAVSDAAYNSIVRLTADIARRYGFGAVTPTNYQGHRQWYSTACPGGFLWARMDNTRSLANKALTGASVPTPTPSTPPVAGKTVWQLADEVLAGHHGSGDARKISLGNQYDAVQAEINRRLGAVVAAPAAKSVSQLADEVLAGAHGNGDARRASLGNLYDAVQNEINRRLGGGGVAPQGVNISQLADAVMRGEYGSGQDRVNRLGANYAAVQAEVNRRFGGGVAVAAPTLAVNISALADAVLRGEYGNGDDRVRLLGANYAAVQAEINRRYA

SEQ ID NO: 952 - protein, 374 aa, unidentified
  REGION 1..374: note = Arthrobacter phage Darby
MTFSSLISGTIPHNNKFSSRQGIPVSRIIQHHFAGSSDGRLRSATEQASSHYIIYNDGSIWGLVPEEYRAWTSGSFEADAPAITYEVQNSSFQINGNDNDPNSWAVSDAAYNSIVRLTADIARRYGFGAVTPTNYQGHRQWYATSCPGGFLWARMDNTRSLANKALTGASVPTPTPSTPPVAGKTVWQLADEVLAGHHGSGDARKISLGNQYDAVQAEINRRLGAVVAAPAAKSVSQLADEVLAGAHGNGDARRASLGNLYDAVQNEINRRLGGGGVTPQGVNISQLADAVMRGEYGSGQDRVNRLGANYAAVQAEVNRRFGGGVAVAAPTLAVNISALADAVLRGEYGNGDDRVRLLGANYAAVQAEINRRYA

SEQ ID NO: 953 - protein, 374 aa, unidentified
  REGION 1..374: note = Arthrobacter phage DevitoJr
MTFSSLISGTIPHNNKFSSRQGVPVSRIIQHHFAGSSDERLRSATEQASSHYVIYNDGSIWGLVPEEYRAWTSGSFEADAPSITYEVQNSSFQINGNDNDPNSWAVSDAAYNSIVRLTADIARRYGFGAVTPTNYQGHRQWYSTACPGGFLWARMDNTRSLANKALTGASVPTPTPSTPPVAGKTVWQLADEVLAGHHGSGDARKISLGNQYDAVQAEINRRLGAVVAAPAAKSVSQLADEVLAGAHGNGDARRASLGNLYDAVQNEINRRLGGGGVAPQGVNISQLADAVMRGEYGSGQDRVNRLGANYAAVQAEVNRRFGGGVAVAAPTLAVNISALADAVLRGEYGNGDDRVRLLGANYAAVQAEINRRYA

SEQ ID NO: 954 - protein, 223 aa, unidentified
  REGION 1..223: note = Muribaculaceae bacterium
MANPDNRRKTPGNINLDKGERSTDLEKEGTQVPELTVEEEAAQQNNSQTTSGTTTSRSTTNPSNRQGSNRGTIPPSSAPEPEKRKGNGRAWLWVICAIVAVVIIVWIMPKSCTEAKEDNEPSKLTETVKTVEADSVATTKTDSVVAAVTTLQEVSEPKGNDKPTTTSVPTVESNSKVGDNVEQEALNVIRGEYGNNPQRRSALGKDYEAVQRRVNQMMKSGKY

SEQ ID NO: 955 - protein, 220 aa, unidentified
  REGION 1..220: note = Muribaculaceae bacterium
MTNDEMKRDARKNVDDVQGRIEQGPVQEQISDHSEVFDDMAEYEAADQLVDDSRKAARSRGWMWVAVAVALLLGAAICVLMIPDLTGSKTQNAIAMAKDKASDGIDKATDAIGRGMAVVSNEADTLVGKTKDAVSGAASATKAYATDAVNAVGTAAGNATDQASQALGTASAATDASAAQIEDEARRVIHGEFGNGAQRRQALGSHYAAVQHRVNELMHA

SEQ ID NO: 956 - protein, 66 aa, unidentified
  REGION 1..66: note = Propionimicrobium lymphophilum
GNGEARRQALGSRYQAVQDRVNQILEANSSSAASDIDRLAHEVINGKYGNGEARRQALGSRYQAVQ

SEQ ID NO: 957 - protein, 283 aa, Chlamydia trachomatis; identical to SEQ ID NO: 152

SEQ ID NO: 958 - protein, 356 aa, unidentified
  REGION 1..356: note = Caudoviricetes sp.
MMSYSSLVEYVKISPNKTSPRDHAIDTITIHCMAGNLTIETCANVFAPSSRQASSNYGVGSDGRIGCYVDEADRSWCSSNRANDMRAITIEVANDGGADTGWHVSGVAMSSLIKLVADVCRRNNIPKLVWSDSKDDRINHRNGCNMTVHRDFANKSCPGDYLMSQMPYIASEVNKLLGASGSSSVSGVVPSNPTPNKTLDEVANEVIRGDWGNGSERKERLEAAGYVYSAVQAKVNELLGSPSSEDISKPEPEPEPTPSYSIDEVAQAVIRGDYGNGSERREKLEAEGYNYSEVQSRVNELCNGGSVSSTPSKSIDTIAREVIRGDWGNGSDRKARLEAAGYNYKEVQARVNALLK

SEQ ID NO: 959 - protein, 269 aa, unidentified
  REGION 1..269: note = Peptoniphilaceae bacterium
MSNSPLVQATILSPNHSGRRNQKITKIAIHHAAGVISGRNLARIFVPKSRQASANYNLGSDGVIVLGVDESNRAWTTSSSWCDNRAVTIEVGNSTRGPQWLVSDYVLNRLIDLVADICRRNGIYPCTYTGGKDGVLQKHEWYSNTNCPGPYLGSKFPYIANEVNKRLRGNKTVSKPTGGLYRVRKSWSNVKSQKGAFKNLENAKRCADRFGLQVFDANGKMVYPVGKTIDQLAREVIRGNWGNGEERKRRLTNAGYDYYAVQKRVNELI

SEQ ID NO: 960 - protein, 269 aa, unidentified
  REGION 1..269: note = Aedoeadaptatus coli
MSNSPLVQATILSPNHSGRRNQKITKIAIHHAAGVINGRNLAGVFVPRARRASANYNLGSDGVIVLGVDESNRAWTTSSSWCDNRAVTIEVGNSTRGPQWLVSDYVLNRLIDLVTDICSRNGIYPCTYTGGKDGVLQKHEWYKSTNCPGPYLGNKFPYIASEVNKRLRGNKTVSKPKNGLYRVRKSWSDVKSQKGAFRNIENAKKCADRFGLKVFDANGKIVYPVGKTIDQLAREVIRGEWGNGEERKRRLTQAGYDYYAVQKRVNQLI

SEQ ID NO: 961 - protein, 269 aa, unidentified
  REGION 1..269: note = Peptoniphilus grossensis
MSNSQLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKRLRGNNTVSKPTSGLYRVRRSFSDVKSQKGAFKNLDNAKRCADRFRLKVFDDNGKIIYPVGKTIDQLAREVISGKWGNGEERKRRLTQAGYDYRAVQRRVNELI

SEQ ID NO: 962 - protein, 269 aa, Peptoniphilus harei
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTFTGGKDDVLQKHEWYKNTNCPGPYLGSKFPYIANEVNKRLRGNNTISKPTGGLYRVRKSWSDVKSQKGAFKNLENAKRCADRFGLKVFDANGKIIHPVGKTIDQLAREVISGKWGNGEERKRRLTQAGYDYRAVQRRVNELI

SEQ ID NO: 963 - protein, 217 aa, unidentified
  REGION 1..217: note = uncultured Duncaniella sp.
MAKQDKSKFQLNKGTDHGFDISKGGKRKFDLTKDDDGPVVASVAQPQPTDSVNSVNPTPEPEEKKNGKWLWVILAIIVIILLIWWLLPGKSTESSPIVEEETIEEVTTPTENTEEVSNEAEIPSGGDAVEENANNDESSNPSEAVVNTQETTPAATQTTNNVATNNASSVVSNDVEAEALKVIRGEYGIGQERKNRLGNRYDAIQQRVNELKREGAF

SEQ ID NO: 964 - protein, 270 aa, unidentified
  REGION 1..270: note = Paratractidigestivibacter sp.
MANVAEFIQCDSRNYTAGRQGNRISKIVVHYTGTEASAHNNLLYFSRSSAGASAHYFIDKDGTLRQSVSEGDTAWHAGHWGTNLCSVGIEVVSGGADFTEAQINALAALVADIRSRCGVSADNVIRHFDVTGKLCPAPYVNGSKWAALHARICGGAASAGSGSSGGGASVSGDVSDLARRVINGEFGNGDARKAALGDRYAEVQAEVNRILGGGGSGGSAGSTGGGSSSVDVDDLARRVIAGEFGNGDARKAALGSNYSAVQARVNEMPS

SEQ ID NO: 965 - protein, 270 aa, unidentified
  REGION 1..270: note = Paratractidigestivibacter sp.
MANVAEFIQCDSRNYTAGRQGNRISKIVVHYTGTEASAHNNLLYFSRSSAGASAHYFIDKDGTLRQSVSEGDTAWHAGHWGTNLCSVGIEVVSGGADFTEAQINALAALVADIRSRCGVSADNVIRHFDVTGKLCPAPYVNGSKWAALHARICGGAASAGSGSSGGGASVSGDVSDLARRVINGEFGNGDARKAALGDRYAEVQAEVNRILGGGGSGASAGSTGSGSSSVDVDDLARRVIAGEFGNGDARKAALGSNYSAVQARVNEMPS

SEQ ID NO: 966 - protein, 482 aa, Streptococcus canis
MTINIETAIAWMAARAGKVTYSMDYRNGPGSYDCSSSVYYALMSAGAISAGWAVNTEYEHDWLMKNGYKLIAENQDWDSKRGDVFIWGIRGQSSGSGGHTGIFIDPDNIIHCNYANNSITINNYNQTAADNGWMYSYVYRLDNQSVGTSTSEKSIDTLVQETLAGKYGNGEQRKAALGNQYEAVMAVINGKATTPKKTIDQLAQEVIAGKHGNGDERKKSLGSEYDAVQKRVTEIIKSGTPFNAPKTPAGKPKSEVVNSTTEPKKAEIEATGKATDTKITKEAGDLSFNGVVLKKSVLDIILAKCKEHDILPSYAITVLHFEGLWGTSAVGKADNNWGGMTWTGKGERPSGVTVTQGTARPSNEGGYYMHYSSVDDFLTDWFYLLRSGGSYKVSGAKTFSEAVKGMFKVGGAVYDYAASGYDNYLVGMSSRLKSIETENGSLSKFDVATVENVGSKDKIEVNIDGIEISINGITYTISKKPV

SEQ ID NO: 967 - protein, 34 aa, unidentified
  REGION 1..34: note = Lachnospiraceae bacterium
IRGDWGNGDERRKRLAAAGYDYSAVQKRVNELLK

SEQ ID NO: 968 - protein, 284 aa, unidentified
  REGION 1..284: note = Caudoviricetes sp.
MSKKVFLSPSNQYDNHYAYGNTTEAVQCGKIAEACKAALIRNGIDVMLMHDESMQEKCQKSNAFGADLHVPIHTNAFNGSVSGTRMFYYADGGEGHKACKAIFAQLAPVTPGNSESIRADASLYEVRVPSAPTAYCECEFHDNANTAKWIVENTTLIGETIAHGICDYFGISFNDGKAPEVVPTPAPSKKSIDELAREVIRGDWGNGSDRRVRLERAGYDYDAVQNRVNEILEGVPSTPKKSIDELAREVIRGDWGNGSARRKALENAGYDYDAVQDRVNEILE

SEQ ID NO: 969 - protein, 293 aa, unidentified
  REGION 1..293: note = Bacteriophage sp.
MKNLWYLSPSDQTDNTGINGYGTEEAQMNALLDVITPHLDRCGVRYHRASRDLGIDYRPAESDRLGADYYLALHSNAGGGGAAYGPIAFYYAAGKELAEELVAQLRATGQKSNRYQSVIQNQNLYETRMMKAASCLLEVDFHNSAEGVNFIVGRRADAARAIAKAICKIDGTAWVDKTVKPTEPEAPDMPPEAPSEAVYVVKYGDTLSGIAREYGTTYQALAAYNGIANPNLIHVGDKIRIPGTAEAPVKSIEDLAREVIRGEWGNGAERRERLTAAGYDYDAVQTRVNTLLG

SEQ ID NO: 970 - protein, 293 aa, unidentified
  REGION 1..293: note = Caudoviricetes sp.
MKNLWYLSPSDQTDNTGINGYGTEEAQMNALVDAITPHLDRCGVRYHRASRDLGIDYRPAESDRLGADYYLALHSNAGGGGAAYGPIAFYYAAGKELAEELVAQLRATGQKSNRYQSVVQNQNLYETRMMKAASCLLEVDFHDSAEGVNFIVGRRADAARAIAKAICKIDGTAWVEESATPAEPEAPDMPPEAPSETVYVVKYGDTLSGIANEYGTTYQALAAYNGIANPNLIHVGDKIRIPGTAEAPVKSIEDLAREVIRGEWGNGAERRDRLTAAGYDYDAVQARVNTLLG

SEQ ID NO: 971 - protein, 344 aa, unidentified
  REGION 1..344: note = Caudoviricetes sp.
MSKKVYLSPSDQTRNTYAYGNTTEAIQCGKIAEACKVALERNGVSVKIGHMISMAQKCSESNAFGADLHVPIHTNAFNGSVMGTRMFCWDGGEGYKACKAIFSVLAPISPGSSESITINKSLYEVKTPNAPTAYIECEFHDNKEGAEWLVKNTVLIGETIAKGICNYFGIAYKASGSTSKPTQEHPTKPTQNQSTSNKELYRVRKSWADAASQIGAFAVLENAIKVCKTGYSVFDSKGNVVYPKAQPAPTKKSVDEIAREVIRGDWGNGSDRTKRLSAAGYDANVVQNRVNEILGGSSTPKKSIDEVAREVIRGEWGNGVDRKNRLVAAGYNYDAVQKRVNEIL

SEQ ID NO: 972 - protein, 279 aa, unidentified
  REGION 1..279: note = Caudoviricetes sp.
MAKRVYLSPSNQTENSYAYGNTTEAAQCGKIAEACRNALVRCGIEVKVGQYDTMANRCAASNAFDADLHVPIHTNAFNGSVTGTRMFCYRKNGEGYKACKSIFAVLAPITPGDSESISVNSELYEVRVPAAPTAYIEVEFHDNEASAKWIVEHTTEIGEAIAKGICNYFDITYKTESKPDQAPSKKSIDELAREVIRGEWGNGADRKNRLTKAGYNYNAIQSRVNQLLGNTPQPAKLSIDELARQVIRGEWGNGHERKERLTEAGYDYDRVQARVNEIL

SEQ ID NO: 973 - protein, 284 aa, unidentified
  REGION 1..284: note = Caudoviricetes sp.
MSKKVFLSPSNQYDNHYAYGNTTEAVQCGKIAKACKAALIRNGIDVMLMHDESMQEKCQKSNAFGADLHVPIHTNAFNSSVSGTRMFYYVDGGEGHKACKAIFARLAPVTPGNSESIRADASLYEVRVPSAPTAYCECEFHDNANTAKWIVENTTLIGETIAHGICDYFGISFNDGKAPEVVPTPAPSKKSVDELAREVIRGEWGNGSNRRVRLERAGYDYDAVQNRVNEILEGAPSTPKKSIDELAREVIRGDWGNGSARRKALENAGYDYDAVQDRVNEILE

SEQ ID NO: 974 - protein, 333 aa, unidentified; identical to SEQ ID NO: 160
  REGION 1..333: note = Clostridiales bacterium

SEQ ID NO: 975 - protein, 159 aa, unidentified
  REGION 1..159: note = Stomatobaculum sp.
MGLDGKPFSSAFNKLANAKNAAEKAAAPAPRPAGQAPAAPSPRPAGQAPAAPSPRPAGQAPAAPSPRPAGLASAATPRPAGPAPAAPTPRPAAFAAKPASPAPAAAAPAPAPQLKSIDEIAKEVIRGNYGNGEERKRRLAAAGYNYEQVQKRVNEMLRK

SEQ ID NO: 976 - protein, 287 aa, Granulicatella adiacens
MIKILRDFVMKDSGFLESFDFVVIHNDAGRMKPQRYISFLRNRDKALGIAHFYCNRDTIVQVVPIENIGYHTGDWWSNCRSVGYEVCESISASDEEFLQNEDVTLLKAAADLVEAGMPISRETVRLHHEFVPTSCPHRSMELHGGTTESVRSYFIERMQYFASLGNNLAEILHNHFPEEEFRMNTWVRHKVFNDDNEIVRQVIRGEWGVGQERIKELTEAGYNAERIQEKVNLALQGSQINDIKTIDALAYEVIQGDWGNGEERKERLEAAGYDYDAVQQRVNEILE

SEQ ID NO: 977 - protein, 308 aa, unidentified; identical to SEQ ID NO: 159
  REGION 1..308: note = Oscillospiraceae bacterium

SEQ ID NO: 978 - protein, 259 aa, unidentified
  REGION 1..259: note = Clostridia bacterium
MFKIALNAGHGKNTAGKRCLKKIDPKETREWVLNSRICDKIEEKLKAYSGYELIRLDDTTGKTDVPLKTRTSKANKFNADFYLAIHHNAGVNGKSGGGVIAIVYKTIKDGSVTNIWQKSLYNEIIKKTGLKGNRAVPLQKQDLHEVRESAMPAVLLECGFMDSTTDTPIILKEDFAEKVADACVNVLADKGNLKKKTAAKTVKPQTKQKTTAAKKTDIDAVARDVIRGLYGNGNERKQRLSALGLNYSVIQKRVNEMLK

SEQ ID NO: 979 - protein, 308 aa, unidentified
  REGION 1..308: note = Oscillospiraceae bacterium
MTRGIDVSRWQGDFDFEAALNEGWEFAVLKGGGGDDGLYVDGRFEENYNKTKKLKIPVGCYFFGYAKNGDEAKKEAEYFYENCLKGKKFELPVFIDVEGDMLKAPKEQLTKTVKSWCETLEKKGFFVGIYASLSVFENNLDDNELLKFTHWVARWAHDCGYKNKDALCMWQFGGNTNLLRSNNVAGVVCDQNYMFIDFESTIKRLGLNGFEKTDGEKADIDKIAREVIRGEWGNGEERKERLKKAGYSYEEVQNRVNELLAEDKKSIDEIANEVIRGEWGNGEERKKRLRDAGYDYDAVQKRVNEKIG

SEQ ID NO: 980 - protein, 61 aa, Anaerococcus hydrogenalis
MKVFDNYGNEIYPRNNNKSIDILAREVIRGDWGNGNERKKRLTQAGYDYYAVQRRVNQILV

SEQ ID NO: 981 - protein, 267 aa, Anaerococcus hydrogenalis
MTNSKLIDDIILSPNHSGIRNQKITKIAIHHSAGIIKGRDLAKIFLPRQRQASANYNLGSDGVIVLGVDEKNRAWTSSSSWCDNRAITIEVGNSTRGPNWEISEFVLNRLVDLVTDICRRNNIYPCTYTGDKNGVLQKHEWYTSTNCPGPYLGNKFSYIANEVNKRLCKNNNSNLYRVRKSFKDVKSQKGAFKSLDNAKNCARKYKLKVFDNYGNEIYPRKNNKPIDILAREVIRGNWGNGNERKKRLTQAGYDYYAVQRRVNQILV

SEQ ID NO: 982 - protein, 267 aa, Anaerococcus hydrogenalis
MTNSKLIDDIILSPNHSGLRNEKISKIAIHHAAGIIKARDLARIFLPRQRQASSNYMIGSDGKIILGVDERNRAWTTSSSWCDNRAITIEVGNSTRGPSWEVSDFVLNRLIDLVTDICRRNNIYPCTYTGNKNGVLQKHEWYANTNCPGPYLGNKFSFIASEVNKRLDKDYKENLYRVRKSFSDKKSQKGAFKSIDNAKKCADKYRLKVFDEDGNEIYPRKNLKSIDTLAREVIRGDWGNGNERKKRLTEAGYDYYAVQRRVNQILS

SEQ ID NO: 983 - protein, 267 aa, unidentified
  REGION 1..267: note = Anaerococcus senegalensis
MTNSKLIDDIILSPNHSGLRNQKITKIAIHHAAGIIKGRDLAKIFLPRQRQASANYNLGSDGVIVLGVDEKNRAWTSSSSWCDNRAITIEVGNSTRGPNWEISDFVLDRLIDLVTDICRRNNIYPCSYTGNKKGVLQKHEWYASTNCPGPYLGKKFSYIANEVNKRLCKNNNSNLYRVRKSFKDVKSQKGAFKSLDNAKNCARKYKLKVFDNYGNEIYPRKNNKPIDILAREVIRGDWGNGNERKKRLTQAGYDYYAVQRRVNQILI

SEQ ID NO: 984 - protein, 267 aa, Anaerococcus hydrogenalis
MTNSKLIDDIILSPNNSGLRNEKITKIAIHHAAGIIKGRDLAKIFLPRQRQASSNYMIGSDGLIVLGVDEKNRAWTTSSSWCDNRAITIEVGNSTRDPSWEVSDFVLNRLIDLVTDICRRNNIYPCTYTGNKNGVLQKHEWYANTNCPGPYLGNKFSFIASEVNKRLEKDYKENLYRVRKSFNDKKSQKGSFKSIDNAKRCADKYRLKVFDEGGKEVYPKKNLKSIDTLAREVIRGDWGNGNERKKRLTEVGYDYYAVQRRVNQILS

SEQ ID NO: 985 - protein, 269 aa, unidentified
  REGION 1..269: note = Anaerococcus ihuae
MTYSKLVDDIILSPNHSGKRSEKISKIAIHHTGGIICGRDLARIFLPKSRGASANYNLGSDGIIVLGVYEENRAWTTSSSWCDNRAITIEVGNSTRGANWEISDFVLDRLIDLVTDICMRNNIYPCTYTGDKEGVLQKHEWYANTNCPGPYLGKKFSYIANEVNKRLRKNARKNSNLYRVRKSFKDIKSQKGAFKSIENAKRCADKYKEKVFDDMGNEIYPRKNNKSIDTLAREVIRGDWGNGNERKKRLTQAGYDYYAVQRRVNQILS

SEQ ID NO: 986 - protein, 269 aa, unidentified
  REGION 1..269: note = Peptoniphilus equinus
MSNSPLVQATILSPNHSGRRNQKITKIAIHHAAGVINGRNLAGIFVPRSRKASANYNLGSDGVIVLGVDESNRAWTTSSSWCDNRAVTIEVGNSTRGPKWLVSDYVLNRLIDLVTDICRRNGIYPCTYTGGKDGVLQKHEWYKNTNCPGPYLGSKFPYIASEVNKRLRGNNTVSKPVGCLYRVRKSWSDVKSQKGAFKNLDNAKRCADRFRLKVFDDNGKIVYPVGKTIDQLARQVINGKWGNGDERRRRLTNAGYDYYTVQRRVNELL

SEQ ID NO: 987 - protein, 267 aa, Anaerococcus hydrogenalis
MTNSKLIDDIILSPNHSGLRNEKITKIAIHHAAGVIKGRDLAKIFLPRQRCASSNYMIGSDGLIVLGVDERNRAWTTSSSWCDNRAITIEVGNSTRGVNWEVSDFVLNRLIDLVTDICRRNNIYPCTYTGNKNGVLQKHEWYANTNCPGPYLGNKFSFIASEVNKRLDKDYKENLYRVRKSFNDKKSQKGAFKSIDNAKKCADKYRLKVFDEGGNEVYPRKNLKSIDTLAREVIRGDWGNGNERKKRLTDAGYDYYAVQRRVNQILS

SEQ ID NO: 988 - protein, 267 aa, Anaerococcus hydrogenalis
MTNSKLIDDIILSPNHSGLRNQKITKIAIHHAAGIIKGRDLAKIFLPRQRQASANYNLGSDGVIVLGVDEKNRAWTSSSSWCDNRAITIEVGNSTRGPNWEISDFVLDRLIDLVTDICKRNNIYPCTYTRDKKGVLQKHEWYASTNCPGPYLGKKFSYIANEVNRRLCKNNNSNLYRVRKSFKDVKSQKGAFKSLDNAKNCARKYKLKVFDNYGNEIYPRKNNKPIDILAREVIRGNWGNGNERKKRLTQAGYDYYAVQRRVNQILV

SEQ ID NO: 989 - protein, 267 aa, Anaerococcus hydrogenalis
MTNSKLIDDIILSPNHSGLRNQKISKIAIHHAAGIIKGRDLAKIFLPRQRQASANYNLGSDGVIILGVDERNRAWTTSSSWCDNRAITIEVGNSTRGPNWEISDFVLDRLIDLVTDICRRNNIYPCTYTGDKEGVLQKHEWYASTNCPGSYLGKKFSYIANEVNRRLCKNNFSNLYRVRKSFKDVRSQKGAFKSIDNAKRCADKYRLRVFDEGGNEVYPRKNLKSIDSLAREVIRGDWGNGNERKKRLIEAGYDYYAVQRRVNQILI

SEQ ID NO: 990 - protein, 274 aa, unidentified
  REGION 1..274: note = Myoviridae sp. ctzS633
MTEKQIRAQVVATAEAWLGVRAGSAQHKEIIKLYNAQRPLPRGTRMQEGWAWCAAFVSAVSLKLGLRDIMPTEMSCHQMVLLYRKLGRWAENDAYVPSPGDVIFYDWDDGRNYASTDNTGTPDHVGIVTACDGKTISVIEGNVNSKVAMRTLAVNGRYIRGFGIPDFSNKATEEEKPAEPDKVGDLARRLATEINDSGLDAVAVLAKVSALLGAKPTEPAKPAEPEKKAPTAAEIDAMARDVIAGKFGNGATRRALLGNNYDEVQKRVNEILRG

SEQ ID NO: 991 - protein, 195 aa, unidentified
  REGION 1..195: note = Caudoviricetes sp.
MMAKYQIVYQKWLPYIGNSDTRGYISNRFSNVHRAIDSVGNYTKGHLYTPVHSAMDGVVTEAYFDRWYGNVVTISNNYISITYCHLAKLLTSTGKQVKAGDIVGREGKTGKYATNGKHLHTKMSIDGKEVDPELYLAGKREFPKKVTYISDDIDQLAWDVIRGKYGNGAARKNALGDKYEAVQERVNELLREMQK

SEQ ID NO: 992 - protein, 193 aa, unidentified
  REGION 1..193: note = Bacteriophage sp.
MAKYKIVYQNWLPYKGNSDTRGYISQRYTNVHRAIDSVGNYTKGHLYTPVHSVMDGVVTEAYFDRWYGNVVTVSNNYISVTYCHLAKLLTSTGKQVKTGDIVGHEGKTGKYAKGKHLHTKMSIDGKEVDPELYLAGKREFPKKVSYISDDIDQLAWDVIRGKYGNGAARKNALGDKYEAVQERVNELLREMQK

SEQ ID NO: 993 - protein, 426 aa, unidentified
  REGION 1..426: note = Bifidobacterium dentium ATCC 27679
MLGGVFFIERKLMKPLFKKFKKAICATIATLCVGGMTAGVALADMNGIDVSGWQAPDITSVVDADFAIVKVNQGTWLNGSWRTQAANAVNTGKELGLYDYASGMNATAEADAFVDRIGGYVGKAMLVLDWESYQNSAFGNSNWIREWVNRVHERTAVWPVVYCSKSVVSQIPSDVRSHCMLWAAQYANNNATGYQSSPWNAGSSGEGMLQYSSSGYLNGRGPLDLDVFFGDRVAWRKISCGERQGCSTSGSGSTGTASTPSATTKTETTTTTTDLNALASAVIRGEYGNGQDRRNRLGGNYDKVMAIVNSRMDGSTYTGSTTVTRTVTRTYVVRSGDTVSAVANRLGLLPVSAWHVPSGNLNRIYVGQTITYTGSAATSTTSYSSSSHVVRSGESLWSIYGTGWSAAASRNGLHYPYTIYPGQTLR

SEQ ID NO: 994 - protein, 152 aa, unidentified; identical to SEQ ID NO: 149
  REGION 1..152: note = Porphyromonadaceae bacterium

SEQ ID NO: 995 - protein, 484 aa, Streptococcus pyogenes
MGINTEAAIAWMSARAGKVTYSMDYRNGPGSYDCSSSVYFALISAGAISAGWAVNTEYEHDWLIKNGYTLIAENQDWDAKRGDVFIWGRRGQSSGAGGHTGIFIDPDNIIHCNYAHNGITVNNYNQTAAASGWMYCYVYRLTNQTSTPSTSPSGKDLDTLVRETLAGKYGNGDTRKAALGNQYEAVMAVINGKATAPKKTIDQLAQEVIQGKHGNGEERKKALGSDYDAVQKRVTEILKGGTSGNAPKTPSDAPKSEVVNSFAEPKTEETGATGKATDAKITKEDGDLSFNGTILKKSVLDVILAKCKEHNILPSYAITVLHFEGLWGTSAVGKADNNWGGMTWTGKGERPSGVTVTQGSARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 996 - protein, 484 aa, Streptococcus pyogenes
MGINIEAAIAWMAAREGKVTYSMDYRNGPGSYDCSSSVYFALMSAGAISAGWAVNTEYEHDWLIKNGYTLIAENQDWDAKRGDVFIWGRRGQSSGAGGHTGIFIDPDNIIHCNYAHNGITVNNYNQTAAASGWMYCYVYRLTNQASTPSTSPSGKDLDTLVRETLAGKYGNGDTRKAALGNQYEAVMAVINGKATAPKKTIDQLAQEVIQGKHGNGEERKKALGSDYDAVQKRVTEILKGSTSRNTPKTSSDAPKSEAVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 997 - protein, 162 aa, unidentified
  REGION 1..162: note = Eggerthellaceae bacterium
ISYKLPHFGSTSDEPDMLCQFSISENGTIYGAQGDQTGNESNFGPYYDYPWDGRLECIDREDTGGGEPVVTDDIDKLAHDVINGVFGNGDARRATLGDKYDAVQARVNEILGGGGSGGGSGMDVDDLSRRVIAGEFGNGRERRDRLGVNYGAVQARVNQMLG

SEQ ID NO: 998 - protein, 85 aa, unidentified
  REGION 1..85: note = Atopobiaceae bacterium
MSELAAWVIAGDFGNGDARRAALGDRYEEVQAEVNRILLGGGSGIDVDAMARRVIAGKFGNGDERKRRLGSYYSIVQARVNEILS

SEQ ID NO: 999 - protein, 306 aa, Solobacterium sp.
MQHTFGGEPHKTATQQIMICFLFAKKKEEDEEMNAKEFFERYNGQAIDDDNAYGVQCVDAFRVFCREIGIDPYPTGTGWADGYWLGRADHADVFDFVEGSQNFRNGDWVVFPRGCVAAPDSHICMYYNGKAFGQRQQGNGDRSFCLIDIDFSQAYGALRAKALEPDPEEPAESIDDIAKEVIAGTWGNGTDRTNALTNAGYDSNAVQARVNELMAQSQPAADIDDLARRTIAGEFGNGDDRRNALGDNYDAVQARVNELMAQSQPAADIDDLARRTIAGEFGDGDARRAALGDLYDQVQARVNEMM

SEQ ID NO: 1000 - protein, 210 aa, unidentified
  REGION 1..210: note = Muribaculaceae bacterium
MAQENDNNRKSRRNFDLEKPVKRSFDLEKEIPQEAASLHQHQQPENVPPMDLPEPPETGKPMKMTWIWICSIIVLVIIVIACIRGCDSAEKAVEPQQAEQLQAPAPADEQETDASAQTQAATETEAADSVAADAAASAASAEEAATPYEPQQPQTDPSPAVTPSASPSIDLEAEAAKVIRGDYGNGDERRARLGENYRAVQNVVNRMLAQ

SEQ ID NO: 1001 - protein, 253 aa, Bifidobacterium ruminantium
MSYEYITQYDSPNYTEGRPYGIACIVIHWWGDPATKPTFDGVIGTLCDPSRRASANYVAEAGRVACLVDPDNRSWASGDGIGVNSMGNDRGISIECNPRQSDGDYETIGELIMDIRSFYGDLPLRRHRDFAATVCPGNYDLARLDRIARTGKSKPSVSKPSASRSSVDIDDLARRVIAGEFGNGDQRRAALGANYALVQARVNQLLGASKPSVDIDDLARRVIAGEFGNGDQRRAALGVNYAAVQARVNQLLS

SEQ ID NO: 1002 - protein, 374 aa, unidentified
  REGION 1..374: note = Arthrobacter phage Sporto
MTFSPLISGTIPNNGKYSSRQGRPVLKVVQHHWAGTGGGIERMTGPDQASCTYVIQSDGKILGHVPEEFRPWTSGSFEADGDAITIEVQNTTGQTNGNDNDPASWQISNAAYASIINLVADIARRYGWGGIAQGNYRGHREFSSTACPGGFLWARMDNTRAQALSVFQGGAAPVPAPVAPPTAGKTVWQLADEVLAGLHGSGDARKASLGAQYDAVQAEVNRRFGVGAAVPKVKTVSQLADEVLAGKHGNGDARRAALGSQYDAVQNEINRRVGGGGVAPTGVNIADLADRTIRGEYGSGDARVRALGTHYAAVQAEVNRRLGGGVAAAPSPRATITDLAHAVIRGEYGSGADRKARLGANYAAVQAEVNRLLK

SEQ ID NO: 1003 - protein, 209 aa, unidentified
  REGION 1..209: note = Muribaculaceae bacterium Isolate-013 (NCI)
MAQENDNNRKSRRNFDLEKPVKRSFDLEKEIPQEAASMHQHPQPENVPPMELPDPPETGKPMRMTWIWICSIIVLVVIVIACIRGCDSAEKTAQQPQQAEQIQAPAPCDESENDASDQAATETEAADSVAADAAASAASAEAAATPYEPQQPQTEPSPAVTPSASPSIDLEAEAAKVIRGDYGNGDERRARLGDNYRAVQNVVNRMLAQ

SEQ ID NO: 1004 - protein, 414 aa, Bifidobacterium dentium
MKPLFKKFKKAICATIATLCVGGMTAGVALADMNGIDVSGWQAPDITSVVDADFAIVKVNQGTWLNGSWRTQAANAVNTGKELGLYDYASGMNATAEADAFVDRIGGYVGKAMLVLDWESYQNSAFGNSNWIREWVNRVHERTAVWPVVYCSKSVVSQIPSDVRSHCMLWAAQYANNNATGYQSSPWNAGSSGEGMLQYSSSGYLNGRGPLDLDVFFGDRVAWRKISCGERQGCSTSGSGSTGTASTPSATTKTETTTTTTDLNALASAVIRGEYGNGQDRRNRLGGNYDKVMAIVNSRMDGSTYTGSTTVTRTVTRTYVVRSGDTVSAVANRLGLLPVSAWHVPSGNLNRIYVGQTITYTGSAATSTTSYSSSSHVVRSGESLWSIYGTGWSAAASRNGLHYPYTIYPGQTLR

SEQ ID NO: 1005 - protein, 481 aa, Streptococcus equi
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLANQSSTSTAGKSLDTLVKETLAGIYGNGDTRKAALGNQYEAVMAVINGKATTPKKTIDQLAQEVIAGKHGNGDERKKSLGSDYDAVQKRVTEILKSGTPSNAPKTPSDKPKSEVVNSTTEPKKAEIEATGKATDTKITKEAGDLSFNGVVLKKSVLDIILAKCKEHDILPSYAITVLHFEGLWGASAVGKADNNWGGMTWTGKGERPSGVTVTQGTARPSNEGGYYMHYSSVDDFLTDWFYLLRAGGSYKVSGAKTLSEAVKGMFMVGGSTYDYAASGYDNYIVGMSSRLKAIEAENGSLAKFDVGTVGNVGSTDKIEVNIEGIEISINGVTYTISKKPV

SEQ ID NO: 1006 - protein, 481 aa, Streptococcus agalactiae
MAINIETAIAWMSARAGKVTYSMDYRNGPGSYDCSSAVYYALMSAGAITAGWAVNTEYQHDWLIKNGYKLIAENQDWNAKRGDVFIWGRRGQSSGAGGHTGIFVDPDNIIHCNYARNGITVNNYNQTAAASGWMYCYVYRLANQPTTSPSGKNLDTLVKETLAGKYGNGDNRKAALGNQYEAVMAVINGKVTTPKKTVDQLAKEVIAGKHGNGDERKKSLGSNYDAVQKRVTEMLKGGTSSNAPKTPTDKPKRDVVNSITTPKKEEIEATDKATNTKMTKEDGDLSFNGAILKKSVLDVILAKCKEHDILPSYAITVLHFEGLWGTSAVGKADNNWGGMTWTGKGERPSGVTVTQGTARPSNEGGHYMHYSSVDDFLTDWFYLLRANGSYKVSGAKTFVDAIKGMFKTGGAVYDYAASGYDNYLVGMSSRLKSIEAENGSLDKFDKQTVMDVGQSDKIEVNIEGIEISINGVTYTISKKPV

SEQ ID NO: 1007 - protein, 481 aa, Streptococcus agalactiae
MAINIETAIAWMSARAGKVTYSMDYRNGPGSYDCSSAVYYALMSAGAITAGWAVNTEYQHDWLIKNGYKLIAENQDWNAKRGDVFIWGRRGQSSGAGGHTGIFVDPDNIIHCNYARNGITVNNYNQTAAASGWMYCYVYRLVNQPTTSPSSKNLDTLVKETLAGKYGNGDNRKAALGNQYEAVMAVINGKVTLPKKTIDQLAKEVITGKHGNGEERKKSLGSDYDAVQKRVTEMLKGGTSSNSPKTPSNNSKSDAVNSTTELKKDEIGATGKATDTKITKEDGDLSFNGAILKKSVLDVILAKCKEHDILPSYAITVLHFEGLWGTSAVGKADNNWGGMTWTGKGERPSGVTVTQGTARPSNEGGHYMHYSNVDDFLTDWFYLLRANGSYKVSGAKTFVDAIKGMFKAGGAVYDYAASGYDNYLVGMSSRLKSIEAENGSLDKFDKLTVTDVGQSDKIEVNIEGIEIKINGVTYTISKKPV

SEQ ID NO: 1008 - protein, 481 aa, Streptococcus agalactiae
MAINIETAIAWMSSRAGKVTYSMDYRNGPGSYDCSSAVYYALMSSGAITAGWAVNTEYQHDWLIKNGYKLIAENQDWNAKRGDVFIWGRRGQSSGAGGHTGIFVDPDNIIHCNYARNGITVNNYNQTAAASGWMYCYVYRLANQPTTSPSGKNLDTLVKETLAGKYGNGDNRKAALGNQYEAVMAVINGKVTLPKKTIDQLAKEVIAGKHGNGEERKKSLGSDYDAVQKRVTEMLKGGTSSNSPKTPSNNSKSDAVNSTTELKKDEIGATGKATDTKITKEDGDLSFNGAILKKSVLDVILAKCKEHDILPSYAITVLHFEGIWGTSAVGKADNNWGGMTWTGKGERPSGVTVTQGTARPSNEGGHYMHYSNVDDFLTDWFYLLRANGSYKVSGAKTFVDAIKGMFKAGGAVYDYAASGYDNYLVGMSSRLKSIEAENGSLSKFDVATVENVGSTDKIEVNIEGIEISINGVTYTISKKPV

SEQ ID NO: 1009 - protein, 481 aa, Streptococcus pseudoporcinus
MAVNIEVAIAWMTSRAGKVTYSMDYRNGPGSYDCSSSVYYALMSAGAVTAGWAVNTEYQHDWLIKNGYKLISENKDWDAERGDVFIWGRRGQSSGAGGHTGIFVDPDNIIHCNYARNGITIDNYNQTAAASGWMYCYVYRLANQSSTSTAGKSLDTLVKETLAGVYGNGDTRKAALGNQYEAVMAVINGKATAPKKTIDQLAQEVIQGKHGNGEERKKALGSDYDAVQKRVTEILKGNTSGSASKTASETPKSDVVNSITDPKKDETGATGKVTEPKIAKEVGDLSFNGAILKKSVLDVILAKCKEHNILPSYAITVLHFEGLWGISAVGKADNNWGGMTWTGKGERPSGVTVTQGTARPANEGGHYMHYASVDDFLTDWFYLLRSGGSYKVSGAKTFSEAIKGMFKTGGATYDYAASGYDNYIVGMSSRLKAIEAENGSLAKFDVATVENVGSKDKIEVNIEGIEISINGVTYTISKKPV

SEQ ID NO: 1010 - protein, 308 aa, unidentified
  REGION 1..308: note = Alloscardovia macacae
MALNGIDISNWQRGINLAAVPADFVVVKATQGTGYVSPAVREQADDALAAGKLLGFYHYASGGSALAEADYFVNTIRDYVGRALLALDFEMGENAAWSNQPNTWIKTFCDRVSATTGVKPLVYIPASGLSRAQGIGDYGLWVAQYANMKPTGYQAAPWNEGAYACAMRQYASTGQLNGYSGNLDLNKFYGDAAAWGKYANPIGNATPATAPAPAPAAVDIEQLARDVIAGKLGDGNTRRERLGANYDAVQARVNQILGANQHTIHVVARGETLSSIAAKYGTNWQHLAQINGLNNPNLIYAGQRITIK

SEQ ID NO: 1011 - protein, 322 aa, unidentified
  REGION 1..322: note = Anaerolactibacter massiliensis
MSNSSLVVYRDMTSGHWNDRAGNKISRIVIHHQAGNLSLQTLGNVFKNRQASAHYGIDSNGRIGQYVDEAYRAWTTSGWEPDRNTVTIEVANSQAGGNWPISDAAMSSLIKLCADICKRNGISRLYYNGKNGTLLRHCDYSATSCPGPYIKEHTNYICDQVNALLGTGSAASTQPNAATGSIDDLAKRTIAGEFGNGDQRRAALGANYNAVQARVNEILGGGSSSQPAVFDVDAAARDVIAGKYGNGDQRRTALGSHYDEVQARVNQMLGAAASTSVNIDAEARKVIRGDYGNGGERRNALVAKFGANVANQIQTRVNDLLR

SEQ ID NO: 1012 - protein, 452 aa, unidentified
  REGION 1..452: note = Streptococcus respiraculi
MTVNTETAIAWFEARKGKVSYSMDYRDGPNSYDCSSSVYYALMSAGAISAGWAVNTEYEHDWLIKNGYTLIAENQDWGAKRGDVFIWGRRGQSSGAGGHTGIFIDSDNIIHCNWGRRGISVDHYDTVAAASCYMYCYVYRLTNQISTTAGKSLDTLVQETLAGKYGNGEERKKALGNQYEAVMAVINGKATTVKKTIDQMAQEVIAGKYGNGEERKKLLGSDYDAVQKRVTEILQGSTSSPVSKPTKEAGDLSFNGAILKKAVLDKILENCKKHNILPSYALTILHFEGLWGTSAVGRTDNNWGGMTMTSNDERITRPSGVTVTRGLARPSNEGGYYMHYATVDDFLTDWFYLLRAGGSYKVSSAKTFSEAVKGMFKVGGAVYDYAATGYENYLVGASSRLKAIEAENGSLTKYDLIPDTPSNLQPDKIDVALDGIEVSINGVKYTLNKKPI

SEQ ID NO: 1013 - protein, 321 aa, unidentified
  REGION 1..321: note = Adlercreutzia caecimuris
MTVYISQASCDERGKYVGGQAGNQSGTELNTRTYYSSSANPWVTYRAKDAATASKIANSAAQAVANMHIGYDQYERNTVRTQAMAVSWVMSAIKKDCECDCTSLAATCCICAGLSDAALFKGGNLMYTGDAATKLVNAGMQRVGSGLAESALRLGDVLVRDGHCVVVTSAPAQSGSTATPSKPTTAVSGSIDELAQAVIAGRFGNGDSRRAALGDKYEAVQKRVNEMLTGTANAPGTSTGTPRIIAGTYKVIASSLNVRSAPSLSGSVVASYGYGDKINSIAADVVEKDGYTWAHYTAYSGATRYVAVGTSNGSEKYLAKC

SEQ ID NO: 1014 - protein, 217 aa, Gracilibacillus saliphilus; identical to SEQ ID NO: 155

SEQ ID NO: 1015 - protein, 324 aa, unidentified
  REGION 1..324: note = Xiamenia xianingshaonis
MGVMVGQASSDERGLYVGGAAGNQSGTELNVRGAYLYNWHTLIRFNDAGRARRCASAMADAVANMNIGYDQGQRNSILPLARAAGWRLGAIARACECDCSSLAGVCGIAAGAPESAIYVGGNLCYTGNIAQRFEATGLVSLYSTSDYVKSTVKWQVGDILVSDTHAVVVVSGGKTPQDGSAPTSNAAGNGTSDVDALARAVIAGRYGVGDARRAALGGKYEAVQARVNEMLSGTPNAAGTSTGTARIIAGTYKVVCGSLNVRARPSLSGAVVASYSRGERIYSVAADTVVADGYVWAHYVAYSGATRYVAMGTADGSEKYLAKS

SEQ ID NO: 1016 - protein, 529 aa, Catenibacterium mitsuokai
MLLDANKQKFVADIAKYAKKYASSYGISVHSPIIAQAILESGWGKSKLATDYHNYFGMKCGTKWTGPSVNMTTQEEYTAGTLTTIKDNFRVYDSMEDGIKGYFEFIQLPRYENLKGITDPQKYIETIRNDGYATSSTYVDSLMQIIKLYNLTSYDNAENAGNGGNEMGSRQAMVAKMQSWIGKNEADGSFREVIDIYNSHTPRARGYKLQYSDEWCAGTVSAAAIATGNTDAVPLEVSCHYMIEGAKAKGIWVENDGYVPQGGDIILYDWQDSGAGDNTGNPDHVGVVEYTSDGVIHVIEGNKGRKVARRELSVNGRYIRGFIVPKYSSNTAPGSGSTPSASGTIDALARRVIAGEFGSGDTRKNALGDKYDAVQKRVNEILNGTASAPAKKSVSEIAKEVLAGAWGNGDARKQKLEAAGYNYSEVQAKVNSLAGGSSSSVDIDALARRVIAGEFGSGDARKKALGDKYDAVQKRVNEMLGGSSSSVNYAAIAKEVINGKWGNGAARKKKLEAAGYNYNKVQKEVNKLL

SEQ ID NO: 1017 - protein, 414 aa, Bifidobacterium dentium
MKPLFKKFKKAICVTIATLCVGGMTAGVALADMNGIDVSGWQAPDITSVVDADFAIVKVNQGTWLNGSWRTQAANAVSSGKELGLYDYASGMNATAEADAFVNNIGGYVGKAMLVLDWESYQNSAFGNGNWIREWVNRVHERTSVWPVVYCSKSVVSQIPSDVRAHCMLWAAQYANNNATGYQSNPWNAGSSGEGMLQYTSSGYLNGRGPLDLDVFFGDRTAWRKIACGERQGCSTSGTGSTGTAGTPTTTTKTETTTTTTDLNALASAVIRGEYGNGQDRRNRLGGNYDKVMAIVNSRMTGSTYTGSTTVTTTVTRTYVVRSGDTVSAVANRLGLLPVSAWRVPSGNLNRIYVGQTITYTGSTTTATTTSTSSSHVVRAGESLWSIYGTGWSAAAARNGLRYPYTIYPGQTLH

SEQ ID NO: 1018 - protein, 484 aa, Streptococcus australis
MGINIETAIAWMSARAGKVTYSMDYRNGPGSYDCSSSVYFALMSAGAISAGWAVNTEYEHDWLIKNGYTLIAENQDWDAKRGDVFIWGRRRQSSGAGGHTGIFIDPDNIIHCNYAHNGITVNNYNQTAAASGWMYCYVYRLANQASTPSTSPSGKDLDTLVRETLAGKYGNGDTRKAALGNQYEAVMAVINGKATAPKKTIDQLAQEVIQGKHGNGEERKKALGSDYDAVQKRVTEILKGSTSGNAPKTPSDAPKSEVVNSSTEPKTEKTGATGEATDTKITKEDGDLSFNGAILKKSVLDVILAKCKEHNILPSYAITVLHFEGLWGTSAVGKVDNNWGGMTWTDKGERPSGVTVTQGSARPASEGGNYMHYASVDDFLTDWFYLLRADGSYKVSGAKTFSEAVKGMFKVGGAVYDYAATGYDNYLVGMSSRLKAIEAENGSLAKFDVGTVDNVGSTDKIEVNIEGIEITINGVTYTISKKPV

SEQ ID NO: 1019 - protein, 47 aa, Streptococcus anginosus
MTNREIMIEELAQEVIKGTFGNGNERERRLGTLYDEVQNKVNEILWR

SEQ ID NO: 1020 - protein, 484 aa, Streptococcus anginosus
MGINIEAAIAWMAAREGKVTYSMDYRNGPGSYDCSSSVYFALMSAGAISAGWAVNTEYEHDWLIKNGYTLIAENQDWDAKRGDVFIWGRRGQSSGAGGHTGIFIDPDNIIHCNYAHNGITVNNYNQTAAASGWMYCYVYRLTNQASTSSTSPSGKDLDTLVRETLAGKYGNGDTRKAALGNQYEAVMAVINGKATAPKKTIDQLAQEVIQGKHGNGEERKKALGSDYDAVQKRVTEILKGSTSRNTPKTSSDAPKSEAVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1021 - protein, 210 aa, unidentified
  REGION 1..210: note = Propionimicrobium lymphophilum
MSYNFLTQYDSPNYGGIYGPISLPCKRLTIHHWDDPAKKPQPFPTINHLCRPNGNSSAHAVVWPGNVACIVNYDRAAWHAGNETGNQTSIGLELDPCHVNETIETVAEYIADLIRQGVLARDFEIYGHKDWSATACPGAYYGRLAEIKNKALARLEGRPAPKPAASPAASDIDRLAHEVINGKYGNGEARRQALGSRYQAVQDRVNQILA

SEQ ID NO: 1022 - protein, 484 aa, unidentified
  REGION 1..484: note = Streptococcus sp. SS6
MGINIEAAIAWMLAKAGKVTYSMDYRNGPNSYDCSSSVYFALMSAGAISAGWAVNTEYEHDWLIKNGYTLIAENQDWDAKRGDVFIWGRRGQSSGAGGHTGIFIDPDNIIHCNYAHNGITLNNYNQTAAASGWMYCYVYRLTNQASTPSTSPAGKDLDTLVRETLTGKYGNGDTRKAALGNQYEAVMAVINGKATAPKKTIDQLAQEVIQGKHGNGEERKKALGSDYDAVQKRVTEILKGSTSGNAPKTPSDAPKSEAVNSSTEPKTEETGAIGEATDTKTTKEDGGLSFNGAILKKSVLDVILAKCKEHNILPSYAITVLHFEGLWGTSAVGKADNNWGGMTWTGKGERPSGVTVTQGTARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1023 - protein, 315 aa, unidentified
  REGION 1..315: note = Parvibacter caecicola
MAVYVAQASCDERGRYTGGQAGNQSGTELNTRAWYPYGWKTVIRFNDPTKAAKCAEAAAKAVANMAIGYDQGQRNTILPLAEAAGWNLAKVSKACECDCTSLAAVCAIAAGASKAVMYEGGNLAYTGNMAERMKRAADVSVFTSAAYTGSSAKLQAGDILVSGSHCVIVTSGAAQPSPAAGADIEALAKAVIAGRYGSGEQRKAALGASYEAVQRRVNEMLAGTANAAGTSTGAPRIVAGTYKVICDGLNVREKPTTDSAKVADYSRGGMIYGVSADTDEADGYLWAHYTAKSGKVRYVAVGSLDGSEKFLAKAA

SEQ ID NO: 1024 - protein, 317 aa, unidentified
  REGION 1..317: note = Arthrobacter phage Teacup
MVLPITGINEQFNAAFFTAGPTEKDGIVIHWWGLPQGQGIDSVRTTFGNGGRQASAHFGATDGEVDCYVNPDDVAWANGNWAANLSKISIECNPRQSDGDYYAAAWTIAYIRSIYGDLPLSRHWDYYPTQCCGTYNLERLDQLAYDIAATGIWNSYQLPTPGTPVVPTPPAPATQAKSIDQLAQEVIAGAYGTGDARRVALGGQYDAVQARVNEILTGVSNAKPQPSISELADRVMRGEFGNGDQRITALGNQYQEVQNEINRRAGISAPVSVPSAPNIEDLVRRTLAGEFGNGDDRVRALGANYTAVQAEINRRYA

SEQ ID NO: 1025 - protein, 317 aa, unidentified
  REGION 1..317: note = Arthrobacter phage Nightmare
MVLPITGINEQFNAAFFTAGPTEKDGIVIHWWGLPQGQGIDSVRTTFGNGGRQASAHFGATDGEVDCYVNPDDVAWANGNWAANLSKISIECNPRQSDGDYYAAAWTIAYIRSIYGDLPLSRHWDYYPTQCCGTYDLERLDQLAYDIAATGIWNSYQLPTPAAPVVPAPPAPATQAKSIDQLAQEVIAGAYGTGDARRVALGGQYDAVQARVNEILTGVSNAKPQPSISELADRVMRGEFGNGDQRITALGNQYQEVQNEINRRAGISAPVSVPSAPNIEDLVRRTLAGEFGNGDDRVRALGANYTAVQAEINRRYA

SEQ ID NO: 1026 - protein, 481 aa, unidentified; identical to SEQ ID NO: 1005
  REGION 1..481: note = Streptococcus equi subsp. zooepidemicus Sz4is

SEQ ID NO: 1027 - protein, 228 aa, unidentified
  REGION 1..228: note = uncultured Clostridium sp.
MGYEFYLDKMLLPITPSKLEIKIKNKNKTYDLINEGEINVLKNAGLSEISFEATFPNVKYPFAVYKNGFVTANHFLNQLELLKTNKKPIQFIVTRLFPNKKSLYNTNIKVSLEDYTIKEDVKQGMDVVVTIKLKQYRDYGTKVCKVTIKQPKPEVKPQPVAKPVVSRPASPAAPSFDVLLAVKKTIRGDYGNGQARKNALGSHYSEVQRQVNLNYRHGTTRWDNIRLY

SEQ ID NO: 1028 - protein, 124 aa, Collinsella intestinalis
MSHPILMKQCGSDHMTRGRTRAIDHIVEHYSGTLASARNNATYFARNERQGASAHFFVDDTSEEIYQPVAEGDTAWHAGDWDVNCRSIGIEIISADEFGNGTERKRKLGARYEVVQKRVNELLS

SEQ ID NO: 1029 - protein, 244 aa, unidentified
  REGION 1..244: note = Caudoviricetes sp.
MSLKNRVLESGLLEVTQEYKPGVHNGIDVVNQNYTLGNIVAHSNGVVVGCRNNCNGFENGSYGNYVKIKHDNGYYTLYGHMAYNTVKVSVGQRVSKGQVLGYMGNTGMSYGGHLHFEVRNTNDVRIDPTEYLNSDLPNSQSVPTKSVEELAQEVIAGKYGNGEDRKNALGDRYVEVQARVNEILAPAPEPSVDILDLVRKTIRGDFGNGEDRRNALGSNYDEVQRQVNLNFQNGTTNWDSVRLY

SEQ ID NO: 1030 - protein, 301 aa, unidentified
  REGION 1..301: note = Bacteriophage sp.
MRGSAALVALFLALAIGITPASAWEERDCIIASGHGTFTPQYLVIHSTANPGATAWNHVQYWQRLGNNTSMTQWVCDWTGEGTVYQVAPGNAITWHVGNGNRHSVGIEICEGVTREQVDKSIDTAAQWAAYYLESRGWGIDRMVSHDEARILWGGTDHTDPNPYFKRWGYTWQGFENKVADYMRGDTGEVKPEHHEQVKPSAPTVTGTTANLAARVMRGEFGSGQARRDALGSRYDEVQAYVNQRYFGVGAGLQTVQPTTAQLAAAVMRGEYGSNPGRRSKLGRRYDEVQRYVNRVYYNIY

SEQ ID NO: 1031 - protein, 322 aa, unidentified
  REGION 1..322: note = Caudoviricetes sp.
MDWKNLNADVNKILNTHYTSGRSGRKINKIIIHYNAGDLTVEGCYSVWQNRPASAHYQVESSGRIGQLVWDSDTAWHASNWDANCSSIGIEHANKEGGYISEACLDAGAHLVAALCKYYGLGRPQWKVNVFPHNHFAATSCPGRLQDEQRDAYMQKAQQWYDQMMNGAESPSTGNKKSSEEVAREVVAGKWGNGADRKNRLTSAGYDYNAIQSLVNQMVGDSNPAPKPTKTIDQLADEVIAGKWGNGADRKNRLTSAGYNYDAVQAKVNEKSYGSKPGKSNEAIAKEVIAGNWGNGADRKARLTAAGYNYDAIQSIVNSLCK

SEQ ID NO: 1032 - protein, 327 aa, unidentified
  REGION 1..327: note = Caudoviricetes sp.
MDWKNLNADVNKILNTHYTSGRSGRKINKIIIHYNAGDLTVEGCYSVWQNRPASAHYQVESSGRIGQLVWDSDTAWHASNWEANCSSIGIEHANKEGGYISEACLDAGAHLVAALCKYYGLGRPQWKVNVFPHNHFAATSCPGRLQDEQRDAYMQKAQQWYDQMMNGAESPSTPSTGNSNKKSSEEVAREVVAGKWGNGADRKNRLTSAGYDYNAIQSLVNQMVGNSNPAPKPTKTIDQLADEVIAGKWGNGADRKNRLTSAGYNYDAVQAKVNEKSYGSKPGKSNEAIAKEVIAGNWGNGADRKARLTAAGYNYDAIQSIVNSLCK

SEQ ID NO: 1033 - protein, 325 aa, Solobacterium sp.
MDWKNLNADVNKILNTHYTSGRSGRKINKIIIHYNAGDLTVEGCYSVWQNRPASAHYQVESSGRIGQLVWDSDTAWHASNWDANCSSIGIEHANKEGGYISEACLDAGAHLVAALCKYYGLGRPQWKVNVFPHNHFAATSCPGRLQDEQRDAYMQKAQQWYDQMMNGAESPSTPSTGNKKSSEEVAREVVAGKWGNGTDRKNRLTSAGYDYNAIQSLVNQMVGNSNPAPKPTKTIDQLADEVIAGKWGNGADRKNRLTSAGYNYDAVQAKVNEKSYGSKPGKSNEAIAKEVIAGNWGNGADRKARLTAAGYNYDAIQSIVNSLCK

SEQ ID NO: 1034 - protein, 239 aa, unidentified
  REGION 1..239: note = Bacteroidota bacterium
MAEIKRKVTIRRKEAPVEKKKPKLWLWLSLAVVVIVGVVLIAKNYSSDKTDSNLIAETEQATAKANEIIADVQSGNVNYEDAKAKVAEAQNTVDEAKANAKTEEEKQAVAEAQTKVDSAVKTVEASKPSTQPLETDKTVTPEQGVASTTPVETSTAVQATSEKAVANTSKDAKSPTDKPNTTATSAPAVYVPEGTLEQKAKQVIRGNFGNGAERKRALGSEYNAIQSKVNEMYRNGEVK

SEQ ID NO: 1035 - protein, 289 aa, unidentified
  REGION 1..289: note = Bacteroidales bacterium
MVTIKRKVTIKQKSVQEEVPRDRKHLKVTLKTKYAEKVEEAEVKPQKNSEATKTQGSQHDLKVSLKTKQKGVSEEKKDAPLPNAEKKQSNISTPKEEKKSNKGIFIGMAIVAALVIGGALLFSDKDATTSENATESAVESIAQNNVNSAALPNELTEQSSKDVSYLETSEEANAEDINTEANNSSAVATRETVSSPSGSTNNTSEQIKDANANSANELSLQNAHEPSEVQTNSSYSRISESLSSDAQENAQRVIRGEFGNGQERKDRLGSSYAEIQNKVNEMYRNGLVH

SEQ ID NO: 1036 - protein, 249 aa, Prevotella sp.
MAELKRKVTLKRKESPQETGKKSKWLLWLLLAIIAVAVVIFVVKNAFSSGMADKIVAEKVEEATAKATGIAAACQNSTVNFEEAQAKVEEAQKAVDEAKANATTDEAKAAVAEAQANVDKAAQAVEAAKRAAEAAQTPVSEETETTANETTVAPKASGQPATTPATGTAEPQPSGQQSVTPAQSRQPTAKSGAGAKPAATLSQGALEEEARKVIRGDYGNGEDRKRVLGSEYNAIQQKVNEMYRNGEVY

SEQ ID NO: 1037 - protein, 213 aa, unidentified
  REGION 1..213: note = Bacteroidales bacterium
MAQETTPRRSDKFDFDKGRKSQKFDFSKENEKVETHAQARRGRTPLCVAAVAIAAVCAVTAAYSLRGGNSADEPAKQRAGLEASRNTTDRSRTAKADATSGQTAEPPSPAAGSTAAAGVKTVNMNTRPARAEDAAPGNNASAETAVGPEEANPSQKHGGDTGALEPRTDEVELAMEVIRGAYGNGESRKERLGARYASVQSRVNAMYRGKSGE

SEQ ID NO: 1038 - protein, 247 aa, unidentified
  REGION 1..247: note = Bacteroidales bacterium
MEEINLKRKVTLKRKGDSESPISPPRKSKWWLWLLLVGVIIVVVLLIVKNNASDSTDKSLIAKTEQTTTKANEVIAEVQSGNVNYEDAKAKVAVAQKEVDEAKANAKTNEEIQAVADAQAKVDEADKIVEASKKATQPLETDKTVTPEQGEGVASTTPVETSKPDNDANQKPVATKTQGSQSSTKKPNTNASSQSNVTVTDGTLEQKAKEVIRGIYGNGADRKIALGSEYDAIQSKVNEMYRNGVVR

SEQ ID NO: 1039 - protein, 159 aa, unidentified
  REGION 1..159: note = Collinsella sp. AM31-2AC
MAAYRELGAHDALCYGAKQRCRIPYATRRHGGVDVGNDNSLCASIESARGLELGRACGRRAVIRGEYGVGAACRNVLGARYKTVQRRVNQMLRWTICWHGIESPGVLSFVSRTVPFAESVWRHFHLRLSLSMCLLLWEGLKLWVSDSVQFSALLFSGFR

SEQ ID NO: 1040 - protein, 325 aa, unidentified
  REGION 1..325: note = Holdemanella sp. MSK.7.32
MDWKNLNADVNKILNTHYTSGRSGRKINKIIIHYNAGDLTVEGCYSVWQNRPASAHYQVESSGRIGQLVWDSDTAWHASNWDANCSSIGIEHANKEGGYISEACLDAGAHLVAALCKYYGLGRPQWKVNVFPHNHFAATSCPGRLQDEQRDAYMQKAQQWYDQMMNGAESPSTPSTGNKKSSEEVAREVVAGKWGNGADRKNRLTSAGYDYNAIQSLVNQMVGNSNPAPKPTKTIDQLADEVIAGKWGNGADRKNRLTSAGYNYDAVQAKVNEKSYGSKPGKSNEAIAKEVIAGNWGNGADRKARLTAAGYNYDAIQSIVNSLCK

SEQ ID NO: 1041 - protein, 324 aa, unidentified
  REGION 1..324: note = uncultured Holdemanella sp.
MDWKNLNADVNKILNTHYTSGRSGRKINKIIIHYNAGDLTVEGCYSVWQNRPASAHYQVESSGRIGQLVWDSDTAWHASNWDANCSSIGIEHANKEGGYISEACLDAGAHLVAALCKYYGLGRPQWKVNVFPHNHFAATSCPGRLQDEQRDAYMQKAQQWYDQMMNGAESPSTPSTGKKTSEEVAREVVAGKWGNGADRKNRLTSAGYDYNAIQSLVNQMVGNSNPAPKPTKTIDQLADEVIAGKWGNGADRKNRLTSAGYNYDAVQAKVNEKSYGSNPGKSNEAIAKEVIAGNWGNGADRKARLTAAGYNYDAIQSIVNSLCK

SEQ ID NO: 1042 - protein, 325 aa, unidentified
  REGION 1..325: note = Holdemanella biformis
MDWKNLNADVNKILNTHYTSGRSGRKINKIIIHYNADDLTVEGCYSVWQNRPASAHYQVESSGRIGQLVWDSDTAWHASNWDANCSSIGIEHANKEGGYISEACLDAGAHLVAALCKYYGLGRPQWKVNVFPHNHFAATSCPGRLQDEQRHAYMQKAQQWYDQMMNGAESPSTPSTGNKKSSEEVAREVVAGKWGNGADRKNRLTSAGYDYNAIQSLVNQMVGNSNPAPKPTKTIDQLADEVIAGKWGNGADRKNRLTSAGYNYDAVQAKVNEKSYGSKPGKSNEAIAKEVIAGNWGNGADRKARLTAAGYNYDAIQSIVNSLCK

SEQ ID NO: 1043 - protein, 325 aa, unidentified
  REGION 1..325: note = Holdemanella biformis
MDWKNLNADVNKILNTHYTSGRSGRKISKIIIHYNAGDLTVEGCYSVWQNRPASAHYQVESSGRIGQLVWDSDTAWHASNWDANCSSIGIEHANKEGGYISEACLDAGAHLVAALCKYYGLGRPQWKANVFPHNHFAATSCPGRLQDEQRDAYMQKAQQWYDQMMNGAESPSTPSTGNKKSSEEVAREVVAGKWGNGADRKNRLTSAGYDYNAIQSLVNQMAGGSKPAPKPTKTIDQLADEVIAGNWGNGADRKNRLTSAGYNYDAVQAKVNEKSYGSKPGKSNEAIAKEVIAGNWGNGADRKARLTAAGYNYDAIQSIVNSLCK

SEQ ID NO: 1044 - protein, 373 aa, unidentified
  REGION 1..373: note = Caudoviricetes sp.
MSLKRDIMFLNGIDISNWQAYIDLTAVPADFVIAKATQGTGYVSPDCARQVEQARQSGKRFGVYHYVSGGNAIAEANYFVDNCANWVGKGLFCIDWESQENSAWGNEGYLEQVVAQVKARTGIPPLIYSSASYYAQVAAVANRQNCGLWIAQYANMNPTGYQDTPWNEGAYACVIRQYSSAGRLPGYGGDLDLNKFYGDGATFDKYVTGGGNISNVPPSQPADPLAGHSDDDLANAVIRGEFGDGDTRKQKLGARYDAVQALVNQKLAKPESSGRTYTVQPGDTLSSISAKLGVAQSQISGFHSGNPNLIYPGEVLSVSGGSPQPSAEYYTVQSGDNLSAIAARYGTSWQHIRDLNGLANPNLIYPGQRLRVK

SEQ ID NO: 1045 - protein, 286 aa, unidentified
  REGION 1..286: note = Caudoviricetes sp.
MVEKINETLMSDSGRLVNLEFVVIHNDAGSMTPKQYIDWLRYRDKDLGIAHYYCNRDCIARVVDTFNIGYHTGDWWSNCRSIGYEVCESMKVNDNEFLQNEDVTLMQATEDLLFYGLPITTQTVRLHHEFVPTTCPHRSMELHGGSTESVKKYFVDRMNYFATLGSTVEEMMGQYNGEVTVEKVTSKENTLKSDETVANEVLQGVWGNGNERIELLTDAGYDAQKIQNIVNRLVLGEDDEDIVDIDEVAQEVIQGEWGNGDERKVRLENAGYNYQAVQDRVNELLG

SEQ ID NO: 1046 - protein, 366 aa, unidentified
  REGION 1..366: note = Bacteriophage sp.
MTLYGIDISNWQAGINLAAVPADFVIAKATQGTGYVSPDCARQVEQARQVGKRFGVYHYVSGGNAVAEANYFVDNCANWVGKGLFCIDWESNENSAWGNEGYLEQVVAQVKARTGIPPIIYVQASRYAQVAAVADRQNCGLWIAQYANMNPTGYQSTPWNEGAYACVIRQYSSTGRLPGYGGNLDLNKFYGDGATYDKYVTGGGNTSNVPPSQPSDPLAGRSDDDLANAVIRGEFGDGDARKQKLGGRYDAVQALVNRKLAKPASPGRTYTVQPGDTLSGIAAKLGVAQSQISGFHSGNPNLIYPGEVLSVSGGSPQPSAEYYTVRSGDNLSAIAARYGTSWQHIRDLNGLANPNLIYPGQRLRVK

SEQ ID NO: 1047 - protein, 366 aa, unidentified
  REGION 1..366: note = Caudoviricetes sp.
MSLNGIDISNWQAYIDLTAVPADFVIAKATQGTGYVSPDCARQVEQARATGKRFGVYHYVSGGNAVAEANHFVDSCINWVNAGLFCIDWESQENSAWGDEGYLEQVVAQVKARTGIPPLIYSSAAYYAQVAAVANRQNCGLWIAQYANMIPTGYQDTPWNEGAYACVIRQYSSTGRLPGYGGNLDLNKFYGDGATFDKYVTGGGNASNVPPSQPTDPLAGRSDDDLANAVIRGEFGDGDARKQKLGGRYDAVQALVNQKLAKPASPGRTYTVQPGDTLSGIAAKLGVAQSQISGFHSGNPNLIYPGEVLSVSGGSPQPSAEYYTVRSGDNLSAIAARYGTSWQHIRDLNGLSNPDLIYPGQVLRVR

SEQ ID NO: 1048 - protein, 472 aa, Streptococcus suis
MALNMEQAIAWMEARRGKVTYSMDYRNGPNSYDCSSAVYYALLSAGAIPPGWVVNTEYEHDWLLKNGFKLIAENSAFSAKRGDIFIWGKKGQSAGAGGHTGIFVDSNNIIHCNYARNGITVDGYLNVARASGSKYAYIYRPPAQSTVPTSTARKSIDQLVQETLAGKYGNGEQRKASLGNQYQSVMDIINGKAKKVEKTDEELAKEVIAGKHGNGEERKRSLGSRYDAVQKRVTELLKKQSSEPSKSSEVKQPTEAKTSRTEPTEKATARKEEGDLSFNGTILKKAVLDKILANCKKHDILPSYAITVLHFEGLWGTSAVGKADNNWGGMTWTGQGNRPSGVIVTQGTARPSIEGGYYMHYANVDDFLTDWFYLLRSGGSYKVSGAKTFSDSVKGMFKVGGAVYDYAASGFDNYIVGASSRLKAIEQENGSLIKYDTATVTDVGQSDKIEVNIEGIEISINGVKYTISKKPV

SEQ ID NO: 1049 - protein, 418 aa, unidentified
  REGION 1..418: note = Bacteriophage sp.
MTRFRKRLMVILAAVLAMFTITPMAFADMQGIDVSNWQCGIDIANTQADFVVVGATWGTGQVNNNCLVSGVNTDANRMIAQAQASGKKFGLYHYAMGGNPEAEAQFFYRNTSNYWRHGIVALDWEMDDNPAWGNWDWVRRFMAECERLSGGVKPLLYTGPVAGTIPGDIRANYGLWIAQYANMSPTGYQANPWMLGAYGEAMRQYSGTGVVNTWSPIDLNIFRGDAWQWDLYANPTGGSTPPATPAAPAQSNTPPANTNTGGISHVMQWGETIWGLAVAYNAWPLSAWHTPSGDINRYYVGDVVTYGGGSTATPAPSVDYNALATAVIRGDYGNDPCRRQRLGGNYDKVMAIVNARLSGQAAPSYTASNAPDYGRSYVVRANDTLSGIAARYGISYTLIHGYRSGNPALIYPGEVLYW

SEQ ID NO: 1050 - protein, 419 aa, unidentified
  REGION 1..419: note = Bifidobacterium santillanense
MNHNKGNPIAKITAACCATIMLATPAIATADSGVDVSNWQGCVNTSRAQSAKNAGTSFAFVKVTEGAGYTDKSADCSMTGFANAGIRRGVYHFARPDLGNSPEKEADWFISQTKGYVNQGVIPVLDWEPGGKWNTQTWWAKRWLDRVTQAWGVKPLIYMSASVVQSGDWRAVASADYGLWVAGYPRGYTGDRLRNPGNVPYNVSPWSFAAAWQYSSSGNVAGVGQAVDVNWFYGDAVTWAKYAGQADTKPVTPPTVTPEEPKPSTPTGDTDTLARAVIRGEYGNMPQRKTLLGSRFDEVQARVNQLLASSGSTSSGSSGSTSVTVRAGDTMSAIAQRTGLYPVTAWSVPSGNINRIYPGQTVTYRGASKTTTSTTRRHTVRAGETLGTIAAANGVSVSQIRGYRSGNPNLIYVGETLYW

SEQ ID NO: 1051 - protein, 367 aa, Bifidobacterium pseudocatenulatum
MSLNGIDISNWQQGIDLSKVPCDFVIAKATQGTGYVSPDCARQIEQARQTGKRFGVYHYVSGGNAVAEANYFIDNCANWVGKGLFCIDWESNENSAWGNEGYLEQVVAQVKARTGIPPIIYVQASRYAQVAAVANRQNCGLWIAQYADMNTTGYQDAPWNEGAYACVIRQYSSSGRLPGYGGNLDLNKFYGDGSVYEKYVTGDGSGSIVAPSQPSDPLAGRSDDDLANAVVRGEFGDGDARRQQLGARYDAVQALVNRKLATPASSGRTYTVQPGDTVSGIAAKLGVAQSQITGFHSGNPNLIYPGEVLAVGGAAAPAQSAGTTYTVQAGDTLSGIASKFGTTYQAIAAKNGIANPNLIYPGQVLHI

SEQ ID NO: 1052 - protein, 419 aa, unidentified
  REGION 1..419: note = Bifidobacterium amazonense
MNHNKGNPIAKLTAACCATIMLATPAIATADSGVDVSNWQGCVNTSRAQSAKAAGTSFAFVKVTEGAGYTDKSADCSMTGFANAGIRRGVYHFARPDLGNSPEKEADWFISQTKGYVNQGVIPVLDWEPGGKWNTQTWWAKRWLDRVASAWGVKPMIYMSASVVQSGDWRAVASADYGLWVAGYPRGYTGDRLRNPGNVPYNVSPWSFAAAWQYSSSGNVAGVGQAVDVNWFYGDAVTWAKYAGQADTKPVTPPTVTPSEPKPSTPTGDTDTLARAVIRGEYGNMPQRKTLLGSRFDEVQARVNQLLASSGSTSSGSSGSTSVTVRAGDTMSAIAQRTGLYPVTAWSVPSGNINRIYPGQTVTYRGASKTTTSTTRRHTVRAGETLGTIAAANGVSVSQIRGYRSGNPNLIYVGETLYW

SEQ ID NO: 1053 - protein, 242 aa, unidentified
  REGION 1..242: note = uncultured Parolsenella sp.
MAGSVSKLVERMRWWCDEANLGYCQANRQDMRVGGEADCSSLVIHCLKEAGFDVGSAMYTGNLRANLVARGWVVCKVDGSPRVGDILLNDGRHVAVCTAAGMVSEASINEKGTANGGAPGDQTGLETRTRKYNSYPWSCYLRYAAAQTGGPSGTADELARRVIAGEFGSGNARRGALGSRYAEVQARVNEILHGGVSGGTQPSMDELARAAGAGRYGVGEARRKALGSRYAEVQRRVNQLLS

SEQ ID NO: 1054 - protein, 139 aa, unidentified
  REGION 1..139: note = Bacteroidales bacterium
MPTNVSPSEDVASLPDAGEQDTEDRVASNENPSEASPSAQNSPNAKASTSEPSASKDVSNDPTTTSNRPSSTDGSNTARESVKPTSSAATALSSSLDENALRVVRGDFGNGQERKDALGSRYDEIQTRVNEMYREGRFN

SEQ ID NO: 1055 - protein, 215 aa, Tannerella sp.
MANNKFNLSKGEEKKGFNLSKNDGAASKFNLSKEQASNTATISGGNSKPEKKSKWRLWLLLVIIAIVVVIFLVRKCSTKGNDAANESTPAQVEQPATVTEQAPAAKEKAVAPTLAAEDTDKPASEETLEPATSEQPTTKPAESVTTPAQSVQPATVKPAASPTLSVLPQGTLEEKVQKVIRGDFGNGEDRKRALGSEYKEIQRKVNEMYRNGNVY

SEQ ID NO: 1056 - protein, 269 aa, Anaerococcus hydrogenalis
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIANEVNKKLRGDKTVSKKAGELYRVRKSWSDAKSQKGAFRNIENAKKCADRFGLKVFDANGKIIYPVGKTIDQLAREVIRGKWGNGEERKRRLTNAGYDYYAVQKRVNKLI

SEQ ID NO: 1057 - protein, 269 aa, Finegoldia magna
MSNSPLVQATILSPNHSGRRNQKITKIAIHHAAGVISGKNLARIFVPRSRQASANYNLGSDGVIVLGVDEANRAWTTSSGWCDNQAVTIEVGNSTRGPQWLVSDYVLNRLIELVTDICRRNGIYPCTYTGGKDGVLQKHEWYSNTNCPGPYLGSKFPYIANEVNKRLRGNKAVSKPTCGLYRVRKFWSDVKSQKGAFRNLDNAKRCADKFGLKVFDANGKIAYPVGKTIDQLAREVISGKWGNGEERKRRLTNAGYDYKEVQRRVNELI

SEQ ID NO: 1058 - protein, 79 aa, Finegoldia magna
KSQKGAFRNLDNAKRCADKFGLKVFDANGKIAYPVGKTIDQLAREVISGKWGNGEERKRRLTNAGYDYKEVQRRVNELI

SEQ ID NO: 1059 - protein, 269 aa, Peptoniphilus harei
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFSYIASEVNKRLRGDKTVNKTTGGLYRVRKSLSDAKSQKGAFKNLDNAKRCADKFGLKVFDANGKIAYPVGKTIDQLAREVISGKWGNGEERKRRLTNAGYDYKEVQRRVNELI

SEQ ID NO: 1060 - protein, 269 aa, Peptoniphilus sp.
MSNSSLVNMVNYSPNHSGRRNQKITKIAIHHTAGAINAATIGQIFKPRSRQASCNYGIGKDNKVILCVEESNRSWCTSSAWCDNRAITIEVANSSNGGNWPVSDKVLAILIDLVTDICKRNGIKNCTYTGGKDGVLQKHEWYSNTNCPGPYLGSKFPYIANEVNKRLRGGNTTSKPSSGLYRVRKSWSDPKSQKGAFKNLDNAKRCADRFGLKVFDANGKIVYPIGKTIDDLAREVIRGDWGNGEERKRRLINAGYDYYLVQKRVNELI

SEQ ID NO: 1061 - protein, 269 aa, Finegoldia magna
MSNSSLIQATILSPNHSGKRNQKITKIAIHHAAGVISGRNLARIFVPKSRQASANYNLGSDGVIVLGVDEANRAWTTSSGWCDNQAVTIEVGNSTRGPQWLVSDYVLNRLIDLVTDICRRNGIYPCTYTGGKDGVLQKHEWYSNTNCPGPYLGSKFPYIANEVNKRLRGNKAVSKPTCGLYRVRKFWSDVKSQKGAFRNLDNAKRCADKFGLKVFDANGKIAYPVGKTIDQLAREVISGKWGNGEERKRRLTNAGYDYKEVQRRVNELI

SEQ ID NO: 1062 - protein, 269 aa, unidentified
  REGION 1..269: note = Gemelliphila asaccharolytica
MSNSPLAQVRILSPNHSGRRNQKITKIAIHHAAGVIGGKNLASVFIPRSRQASANYNLGSDGVIVLGVDESNRAWTTSSSWCDNRAVTIEVGNSTRGPQWLVSDYVLNRLIDLVTDICRRNGIYPCTYTGGKGGVLQKHEWYSNTNCPGPYLGSKFPYIANEVNKRLKGNKTVGKPTGGLYRVRNSWSDVKSQKGAFKNLDNAKRCADKFGFKVFDTNGTKVYPLEKTIDQLAREVISGKWGNGEERKRRLTNAGYDYYAIQRRVNELI

SEQ ID NO: 1063 - protein, 269 aa, unidentified
  REGION 1..269: note = Peptoniphilus lacydonensis
MSNSPLVNMVNYSPNHSGRRNQHITKIAIHHTAGAINAATIGQIFKPRSRQASCNYGIGKDNKVILCVDEQNRSWCTSSAWCDNRAVTIETANSSNGGSWPVSDQVLETLIKLVTDICIRNGIYPCTYTGGKDGVLQKHEWYSNTNCPGPYLGSKFPYIANEVNKRLRGGSPTNKTSSRLYRVRKSWSDAKSQKGAFRNLANAKRCANRFGLKVFDLNGKIVYPAGKTIEQLAKEVIRGDWGNGEERKRRLRQAGYDYYEVQRRVNELI

SEQ ID NO: 1064 - protein, 269 aa, unidentified
  REGION 1..269: note = Peptoniphilus faecalis
MSNSPLVQSTIRSPNHSGRRNQKITKIAIHHAAGVINSRNLAGVFVLRSRLASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKRLRGDKTVSKSVGGLYRVRKFWSEVNSQKGAFKNLDNAKRCADRFRLKVFDANGKIVYPKDKTIDQLAREVISGKWGNGEERKRRLINAGYDYYAIQRRVNELI

SEQ ID NO: 1065 - protein, 269 aa, Finegoldia magna
MSNSSLVQATILSPNHSGRRNQKITKIAIHHAAGVISGKNLARIFVPKSRQASANYNLGSDGVIVLGVDEVNRAWTTSSGWCDNQAVTIEVGNSTRGPQWLVSDYVLNRLIDLVTDICRRNGIYPCTYTGGKDGVLQKHEWYKNTNCPGPYLGSKFPYIASEVNKRLRGNNTVSKPTGGLYRVRKSWSDVKSQKGAFKNLDNAKRCADRFRLKVFDANGKIVHPVGKSIDQLAREVISGKWGNGEERKRRLTQAGYDYKEVQRRVNELI

SEQ ID NO: 1066 - protein, 269 aa, Finegoldia magna
MSNSPLVQATILSPNHSGRRNQKITKIAIHHAAGVISGRNLARIFVPKSRQASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNKAVSKPTCGLYRVRKFWSDVKSQKGAFRNLDNAKRCADKFGLKVFDANGKIAYPVGKTIDQLAREVISGKWGNGEERKRRLTNAGYDYKEVQRRVNELI

SEQ ID NO: 1067 - protein, 269 aa, unidentified
  REGION 1..269: note = Urinicoccus massiliensis
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLKRLIDLVTDICRRNGIYPCTYTGGKDGVLQKHEWYKNTNCPGPYLGSKFPYIANEVNKRLRGNNTVSKPTGGLYRVRKSWSDVKSQKGAFKNLENAKRCADRFRLKVFDANGKIVYPVGKTIDQLAREVISGKWGNGEERKRRLTQAGYDYRAVQRRVNQLV

SEQ ID NO: 1068 - protein, 269 aa, Peptoniphilus harei
MSNSPLVQATILSPNHSGRRNQKITKIAIHHTAGVINGRNLAGVFVPRSRRASANYNLGSDGVIVLGVDESNRAWTTSSSWCDNRAVTIEVGNSTRGPQWLVSDYVLKRLIDLVTDICRRNGIYPCTYTGGKDGVLQKHEWYKSTNCPGPYLGSKFPYIANEVNKRLRGNNTISKPTSGLYRVRKSWSDSKSQKGAFKNLENAKRCADRFGLKVFDTNGKIVYPIGKTIDQLAREVISGKWGNGEERKRRLTQAGYDYKAVQKRVNELI

SEQ ID NO: 1069 - protein, 269 aa, unidentified
  REGION 1..269: note = Peptoniphilus rhinitidis
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFSYIANEVNKRLSGNNTVSKPTSGLYRVRRSFSDVKSQKGAFKNLDNAKRCADRFRLKVFDDNGKIVYPVGKTIDQLAREVISGKWGNGEERKRRLTQAGYDYKAVQKRVNELI

SEQ ID NO: 1070 - protein, 269 aa, unidentified
  REGION 1..269: note = Peptoniphilus vaginalis
MSNSPLVQATIRSPNHSGRRNQKITKIAIHHAAGVINGRNLAGVFVPKSRLASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIAREVNKRLKGNKTVGKPTGGLYRVRNSWSDVKSQKGAFKNLDNAKRCADKFGFKVFDTNGTKVYPLEKTIDQLAREVISGKWGNGEERKRRLTNAGYDYYAIQRRVNELI

SEQ ID NO: 1071 - protein, 269 aa, Peptoniphilus lacrimalis
MSNSPLVQARILSPNHSGRRNQKITKIAIHHAAGVINGRNLAGVFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIANEVNKRLRCNKTVSKPTGGLYRVRKSWSDVKSQKGAFKNLENAKKCADKFGLKVFDVNGKIVYPVGKTIDQLAREVIRGDWGNGEERKRRLTQAGHDYYAVQKRVNQII

SEQ ID NO: 1072 - protein, 269 aa, Anaerococcus vaginalis
MSNSSLIQATILSPNHSGRRNQKITKIAIHHAAGVISGRNLARIFVPKSRQASANYNLGSDGVIILGVDEANRAWTTSSGWCDNQAVTIEVGNSTRGPQWLVSDYVLNRLIDLVTDICRRNGIYPCTYTGGKDGVLQKHEWYKNTNCPGPYLGSKFPYIASEVNKRLRGNNTVSKPTGGLYRVRKSWSYVKSQKGAFKNLDNAKRCADRFRLKVFDANGKIVHPVGKSIDQLAREVIRGEWGNGEERKRRLINAGYDYYVIQKRVNELI

SEQ ID NO: 1073 - protein, 269 aa, Anaerococcus vaginalis
MSNSPLVQATILSPNHSGRRNQKITKIAIHHAAGVINGRNLAGIFVPRSRRASANYNLGSDGIIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNKTVSKRQDALYRVRKSWSDIKSQKGAFKNLENAKRCADRFGLKVFDANGKIVYPVGKTIDQLAREVIRGEWGNGEERKRRLTNAGYDYYVIQKRVNELI

SEQ ID NO: 1074 - protein, 269 aa, Finegoldia magna
MSNSPLVQATILSPNHSGRRNQKITKIAIHHAAGVINGRNLARIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKRLRGDKTVSKPTGGLYRVRKSWSDVKSQKGAFKDLENAKRCADRFGLKVFDANGKIVYPVGKTIDELAREVIRGDWGNGEERKRRLTQAGYDYYAIQRRVNKLI

SEQ ID NO: 1075 - protein, 269 aa, unidentified
  REGION 1..269: note = Peptoniphilus hominis
MSNSPLVQATILSPNHSGRRNQKITKIAIHHAAGVINGRNLAGVFVPRSRRASANYNLGSDGVIVLGVDEANRAWTTSSSWCDNRAVTIEVGNSTRGPQWLVSDYVLNRLIDLVTDICRRNGIYPCTYTGGKDGVLQKHEWYKNTNCPGPYLGSKFPYIANEVNKKLRSDKTVSKSVSGLYRVRKSWDDTKSQKGAFKNLDNAKRCADRFGLKVFDANGKIVYPVGKTIDELAREVIRGKWGNGEERKRRLTQAGYDYYAVQKRVNKLI

SEQ ID NO: 1076 - protein, 332 aa, unidentified
  REGION 1..332: note = Micrococcus phage Olihed
MAKFSSLIDGTTSDHGKNRGSDPNKKRIIVHHWAGTAGGDTALMKPKGQNSRGDVSASYILYSSGKLIGQVSEEYSPWTTGSADWGSVTVETQNAANGGNWPIDQRAKDKLAQLMADLSDRYGWGELKLGTNVRYHGEFYATACPGPDMIASLPAIIAKANQLRKGGGGKPSGGGDTGTYTVSKGETLSGIAAKYGTTWQVLQSLNGLSDPNKIYPGQKIKVPGSSGGGTSKPSQSLSEVAKAVIRGDYGNGSTRVAKLRAAGYDPAEVQREVNRQLGIGGSTTTSTNASTIDRLAREVIRGDWGNDPERKRRLEAAGYDYSAVQRRVNQLI

SEQ ID NO: 1077 - protein, 210 aa, unidentified
  REGION 1..210: note = Muribaculaceae bacterium
MTNDEMKRNAGKATDDVQGRIEQGPVQEQISDHSEVYDDMPEYEAADQLIDDSRKAARKRGWMWIAVAIALVLGAAICVLMIPELTGTKTGDALAAAKTTVSNGLDKVSDAAGSGVAVIEEAVGSVQEGVTDAAQATAGAVSDAKDKVSDAVDNAAADAAAASTDVSAATIDDEARRVIHGDFGNGAQRKAALGSHYAAVQHRVNELLHV

SEQ ID NO: 1078 - protein, 221 aa, unidentified
  REGION 1..221: note = Podoviridae sp. ctKzN3
MTNSEFIEQIATYVKKYAYVYGIEVHSPIIAQAILESGWGKSSLASKYHNYFGLKCGSAWKGKSVNMATQEEYTVGVMTDIRDNFRVFDSMEDGVKGYFDFINYSRYANLKGVKDTEEYCRRIKADGYATSSKYVDSLLRVIRDNNLTRFDNNEPIKEEPKKEDGDNMRKEELTGDILSGKEIIDILAKRVIKGDYGNGRERQNKLGDLYSIVQKRVNELC

SEQ ID NO: 1079 - protein, 100 aa, unidentified
  REGION 1..100: note = Caudoviricetes sp.
MCKYCGRDPRMVARSLNLNDFSADALAEAVLRGEFGNGIYRMEALGARYDEVQALVDKKIDGYARRVLRGEFGNGRERKARLGYLYPAVQERVNQLVRMR

SEQ ID NO: 1080 - protein, 217 aa, unidentified
  REGION 1..217: note = Bacteroidales bacterium
MAKQDKSKFQLNKGTDHGFDISKGGKRKFDLTKDVDEPVVAPTAEPQPTAPGNSVKQTPEPEEKKNGKWFWVILAIIVIIFMVWWLLPGKSTDSEPIVEEGTIEEVTTPAENTEEVSNESEIPAGGDAVEKNANNDESSNSSESIVNTQEITPVATQTTNNVVTNNAPSVVSNDVEVEALKVIRGEYGIGQERINRLGNKYDAIQQRVNELKREGAF

SEQ ID NO: 1081 - protein, 217 aa, Bacteroides sp.
MAKQDKSKFQLNKGTDHGFDISKGGKRKFDLTKDVDEPVVAPTAEPQPTAPGNSVKPTPEPEEKKNGKWFWVILAIIVIIFLVWWLLPGKSTDSEPIVEEETIEEVTTPAENTEEVSNESEIPAGGDAVEKNANNDESSNPSESIVNTPEITPVATQTTNNVVTNNAPSVVSNDVEVEALKVIRGEYGIGQERKNRLGNKYDAIQQRVNELKRKGAF

SEQ ID NO: 1082 - protein, 88 aa, unidentified; identical to SEQ ID NO: 143
  REGION 1..88: note = Muribaculaceae bacterium

SEQ ID NO: 1083 - protein, 100 aa, Actinomyces sp.
MCKYCGRDPRMVARSLNLNDFSADALAEAVLRGEFGNGIYRMEVLGARYDEVQAMVDKKIDGYARRVLRGEFGNGRERKARLGYLYPAVQERVNQLVRMR

SEQ ID NO: 1084 - protein, 262 aa, unidentified
  REGION 1..262: note = Bacteroidales bacterium
MEKKEQRFQLNKGGEHKFDIHKGGKRKFDLTKDADETPVEKAPEVQPAKAHVAPAPAASAPTTKSEATELKPKTKEPKQPQAPTISPSEDRPSNRSQGWIWGIVAVIALLCLIWLFWPTDEETPAMAQAETEQVEPAGEVADVQDAGDVDAVEAETVEAEAVSADQAKENVAATSATESNNVVTSDQSSAVAANPSSAQSAEQPASTMKTVPTSSPSGDIEAVAADVIRGTYGNGMERKDCLGSRYAEVQARVNQMKKQGLF

SEQ ID NO: 1085 - protein, 100 aa, unidentified
  REGION 1..100: note = Actinomycetaceae
MCKYCARDPRMVARSLNLNDFSTDALAEAVLRGEFGNGIYRMEALGARYDEVQAMVDKKIDGYARRVLRGEFGNGRERKARLGYLYPAVQERVNQLVRMR

SEQ ID NO: 1086 - protein, 217 aa, unidentified
  REGION 1..217: note = Barnesiella sp. WM24
MAKQDKSKFQLNKGTDHGFDISKGGKRKFDLSKDDDEPVVAPVAQPQPTDSVNSVNPTPEPEEKKNGKWLWVILAIIVIILLIWWLLPGKSTESSPIVEKETIEEVTTPAENTEEVSNEAEILSGGDAVEENANNDESSNPSEAVVNTQETTPAAPQTTNNVATNNAPSVVSNDVEAEAIKVIRGEYGIGQERKDKLGKHYEAIQRRVNELKREGAF

SEQ ID NO: 1087 - protein, 217 aa, unidentified
  REGION 1..217: note = Barnesiella sp. CU968
MAKQDKSKFQLNKGTDHGFDISKGGKRKFDLSKDDDEPVVASVAQPQPTDSVNSVNTTPKPAKKKNGKWLWVILAIIVIILLIWWLFPGKSTESAPIVEEETIEEVTTPAENTEDVSNEAEISAGEDAGEENANNDESSNPSEAVVNTQETTPAAPQTTNNVATNNAPSVVSNDVEAEAIKVIRGEYGIGQERKVKLGNYYEAIQRRVNELKREGAF

SEQ ID NO: 1088 - protein, 234 aa, unidentified
  REGION 1..234: note = Prevotella jejuni
MVEIKRKVTLRTKTSQPEEKPATEVTPEVQSSASQQEPTPTPPPPTEPTTNAKGSKGGGKWKEWLAAFVLASLLLGGYHLYSNSQGNDAQDATTVAKTDSTDAQKDSTQTAQADSTTKVKPEADGNNVATETANETAAEDNSVSKTTTPSSNTSANNTTANTTTDQQTASTDNLGTSSTTEPTAAEPANSVQETAKDVIRGTYGNGVTRRHRLGSRYEEVQKRVNEMYRQGLIR

SEQ ID NO: 1089 - protein, 234 aa, unidentified
  REGION 1..234: note = Prevotella jejuni
MVEIKRKVTLRTKTSQPEEKPATEVTPEVQLSASQQEPTPTPPPPTEPTTNAEGSKGGGKWKEWLAAFVLASLLLGGYHLYSNSQGNDAQDTTTVAKTDSTDAQKDSTQTAQADSTTKVKPEADGNNVATETANETAAEGSSVSKATTPSSNTSANNTTANTTTDQQTASTDNLGTSSTTEPTAAEPANSVQETAKDVIRGTYGNGVTRRHRLGSRYEEVQKRVNEMYRQGLIR

SEQ ID NO: 1090 - protein, 100 aa, unidentified
  REGION 1..100: note = uncultured Actinomyces sp.
MCKYCGRDPRVVARGLNLNDFSADALAEAVLRGEFGNGVYRMEALGARYDEVQALVDKKIDGYARRVLRGEFGIGRERKRRLGYLYPAVQERVNQLVRMR

SEQ ID NO: 1091 - protein, 234 aa, unidentified
  REGION 1..234: note = Prevotella jejuni
MVEIKRKVTLRTKTSQPEEKPATEVTPEVQLSASQQEPTPTPPPPTEPTTNAKGSKGGVNWKEWLAAFVLASLLLGGYHLYSNSQGNDAQDTTTVAKTDSTDAQKDSTQTAQADSTTKVKPEADGNNVATETANETAAEGSSVSKATTPSSNTSANNTTANTTTDQQTASTDNLGTSSTTEPTAAEPANSVQETAKDVIRGTYGNGVTRRHRLGSRYEEVQKRVNEMYRQGLIR

SEQ ID NO: 1092 - protein, 234 aa, unidentified
  REGION 1..234: note = Prevotella jejuni
MVEIKRKVTLRTKTSQPEEKPATEVTPEVQLSASQQEPTPTPPPPTEPTTNAKGSKGGVNWKEWLAAFVLATLLWGGYHLYSNSQGNDAQDATTVAKTDSTDAQKDSTQTAQADSTTKVKPEADGNNVATETANETAAEGSSVSKATTPSSNTSANNTTANTTTDQQTASTDNLGTSSTTEPTAAEPANSVQETAKDVIRGTYGNGVTRRHRLGSRYEEVQKRVNEMYRQGLIR

SEQ ID NO: 1093 - protein, 234 aa, unidentified
  REGION 1..234: note = Prevotella jejuni
MVEIKRKVTLRTKTSQPEEKPATEVTPEVQLSASQQEPTPTPPPPTEPTTNAEGSKGGGKWKEWLAAFVLATLLWGGYHLYSNSQGNDAQHTTTVAKTDSTDAQKDSTQTAQADSTTKVKPEADGNNVATETANETAAEDNSVSKTTTPSSNTSANNTTANTTTDQQTASTDNLGTSSTTEPKAAEPANSVQETAKDVIRGTYGNGVTRRHRLGSRYEEVQKRVNEMYRQGLIR

SEQ ID NO: 1094 - protein, 309 aa, unidentified
  REGION 1..309: note = Caudoviricetes sp.
MKKIFGIDVSDWQGDIDWEKAKAAGVKFALLKCGYGMDLTDQDDACFERNASECERLGIPFGVYLYSYANTMEKAKSEAAHVLRMLKGRKPQYPVYLDLEDQITLSVSKEQILAQVKAWCEIIEGAGYKTGIYANLYWWDTYLTAPWYDTKERWVAQYYTKCEYAKDYGIWQYTSRGSVDGVNGNVDCDWCYKDYLATEPEAPDMPPEAPSETVYVVKYGDTLSGIAKEYGTTYQTLADYNGIANPNLIHVGDKIRIPGTGEAPVKSIEDLAREVIRGEWGNGDEREKRLTAAGYDYDAVQTRVNTLLG

SEQ ID NO: 1095 - protein, 357 aa, unidentified
  REGION 1..357: note = Caudoviricetes sp.
MAKVYLSPSNQTDNRYAYGNTTEAVQCGKIADACRIALERSGVTVKVGHMIHMSEKIAQSNAFGADLHVPIHTNAFNGKVTGTRMFCFSSSGEGMKACKAIFARLAPITPGTSESIQVNDYDEIVYTNAPAAYVECEFHDNAKAAKWIVEHTTDIGEAIAQGICDYFGVTFKAPEQPAPAKSVDEVAREVIRGEWGNGSDRRQRLDAAGYDYDAVQDRVNELLNSKEEPEQPDKPTTLDVNVGEIVDFKGGKHYTSANATSGTEVKASKAKVTAKSSGKHPIHLRAVNDKGAYISGVYGWVDLSTITTGSVVKKSVNEIALEVIAGKWGNGAERRCKLESAGYDYAAVQKRVNELPI

SEQ ID NO: 1096 - protein, 328 aa, unidentified
  REGION 1..328: note = Caudoviricetes sp.
MSNSSLVNMTMLSPNHSGRRNQPITKIAIHHTAGAISAATIGQIFRPTSRQASCNYGIGNDNKIVLCVDEANRSWCTSSSWCDNRAVTIEVANSANGGNWPVSDRTLATLIDLVTDICRRNGIKNCTYTGGKDGVLQKHEWYANTNCPGPYLGSKFSYIASEVNKRLSGNSSSSGGASTSSLYRVRKSWSDVKSQKGAFRDFDNAKKCANANAGYKVFDASGNEVYPNKATSSKSVDTLAHEVLAGNWGNGSDRVNQLRAAGYDYDAVQNRVNEILSGGSNSTSGKSIDTLAHEVIRGDWGNGQDRKNRLERAGYDYNAVQRRVNELL

SEQ ID NO: 1097 - protein, 289 aa, unidentified
  REGION 1..289: note = Bacteriophage sp.
MAMPKVYLAPSNQVENRYAYGDTTEAVQCGKIAEACKAALERSGVTVQVGHMIHMSEKIAQSNAFGADLHVPIHTNAFNGTVTGTRMFCFSSGGEGMKACKAIFARLAPITPGTSESIQVNDYDEIVYTNAPAAYVECEFHDNAKTAQWIVEHTTDIGEAIAQGICDYFGVTFKAPEQAVPAKSVDEVAREVIRGEWGNGSDRRQRLEAAGHNYDAVQDRVNAILTGDEPEQPAEPTPTEPVEPAPEPEEPATDKLYRVQVGAFANRENAERMLQRLKDAGFEGFIREV

SEQ ID NO: 1098 - protein, 327 aa, unidentified
  REGION 1..327: note = Caudoviricetes sp.
MSNSSLVNMTMLSPNHSGHRNQPITKIAIHHTAGSISAATIGQIFRPTSRQASCNYGIGNDNKIVLCVDETNRSWCTSSSWCDNRAVTIEVANSANGGNWPVSDRTLATLIDLVTDICRRNGIINCTYTGGKEGVLQKHEWYAATNCPGPYLGSKFPYIAAEVNKRLASGSSSSNTGTSFLYRVRKSWSNPKSQKGAFRNLDNAKKCANANPGYSVYDANGRSVYPVTSSQSKSIDTLAREVIAGNWGNGQDRVNRLTSAGYNYNAVQERVNEILSGNASKPTEKSIDTLAREVIRGDWGNGQDRKNRLERAGYDYNAVQRRVNELL

SEQ ID NO: 1099 - protein, 306 aa, unidentified
  REGION 1..306: note = Caudoviricetes sp.
MSKKGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCSKLEACGYYAGFYTSLSTANNLVSSHVRNRYALWIAQWNTHCNYQGSYGLWQYSSNGSVPGVAGRVDMDYAYKDYPSIIKNVGLNGCKNGGSDQATRTSSIDEVAREVINGAWGNGNERKQRLTQAGYDYASVQNKVNELLGVKAYRKSVDELAREVIRGAWGNGNERKQRLTQAGYDYDTVQKRVNELL

SEQ ID NO: 1100 - protein, 349 aa, unidentified
  REGION 1..349: note = Caudoviricetes sp.
MSNSSLVSYTKLSPNCDHPRNHAIDKITIHHMAGDLSVETCGNLFAKPSYEASSNYGIGSDGRVGLYVDEGDRAWASASPSNDNRAVNIEVANCATGGDWPVSNAAYSKLIDLCVDICQRNGIKALNYTGGADGNLTEHRMFTATACPGPYLHKRMGRIAAEVNSRLSAQPAKSVDEVAREVIRGEWGNGSDRRQRLEAEGYDYDAVQDRVNELLNSKEEPEQPGKPTTLDVNVGEILDFKGGKHYTSANATSGTEVKASKAKVTAKSSGKHPIHLRAINDKGAYISGVYGWVDLSTITTGSVVKKSVNEIAREVIAGKWGNGAERRCKLESAGYNYAAVQKRVNELLR

SEQ ID NO: 1101 - protein, 533 aa, unidentified
  REGION 1..533: note = Caudoviricetes sp.
MMTNKELAAKLIDVAKNYKTLYVMGCFGAPMTASNKKRYTQNNEYNRRPERTAMINAASADTFGFDCVCLIKGVLWGWKGDKNAVYGGATYASNGVPDIGADSMIKVCKNVTTDFSHIEVGEAVWTEGHIGVYVGNGLAVECTPRWDNKVQITACNRSVSGYNRRNWTKHGKLPYVKYEAGAEAPSVPASGVKGIDVSKWQGEIDWAKVKAAGVKFAMIRLGYGSADGASCGLDGWFERNVANAVKAGVEVGCYFYSYATSVAAAKKEADFVVSVLQKYKGVFTYPVAFDLEDKTQQSLGQTVLTDMVIAFGDTIEKAGFYCSLYSNLDWLKNRLDDSRLKRFDHWLAQWASAPSYTGAFGMWQNSSKGSVNGISGNVDTDIAYKDYPSIIRGAKLNGFNSSAQEPTVPVQPEEPPKPAASFKKGDLVKITGTKYYSGKTIPAWVKAKNWYVLQADGARVVIDRSEDGRNAICSPVNAADLQLVSAKPGKTVDELAREVICGLWGNGADRRNRLTAAGYSYDAVQRRVNELLR

SEQ ID NO: 1102 - protein, 306 aa, unidentified
  REGION 1..306: note = Caudoviricetes sp.
MSKRGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCNKLESCGYYAGFYTSLSTANNLVSAHVRNRYALWIAQWNTHCNYQGSYGLWQYSSSGSVPGVAGRVDMDYAYVDYPSIIKNAGLNGCKNGGSDQAARTSSIDEVAREVINGAWGNGNERKQRLTSAGYDYASVQNKVNELLGVKAYRKSVDELAREVIRGAWGNGNERKQRLTQAGCDYDTVQKRVNELL

SEQ ID NO: 1103 - protein, 535 aa, unidentified
  REGION 1..535: note = Caudoviricetes sp.
MMTNIELVNKLKDIAKNYKTLYVMGCFGAPMTASNKKRYTQNNEYNRRPERMAMINAASADTFGFDCGCLIKGVLWGWHGDKNAVYGGATYASNGVPDYGADTMITVCKNVSTDFSKIEVGEAVWMEGHIGVYIGGGLAVECTPRWDNKVQITACNRSVSGYNRRNWTKHGKLPYVKYESVPETPSDPVTTAVKGIDVSKWQGEIDWAKVKAAGVKFAMIRLGYGSADGSACGLDGWFERNVQRAVKGGVEVGCYFYSYATSVAAAKKEAAYVVSVLQKYKGVFTYPVAFDLEDKTQQNLGRTVLTDMVIAFGDAIEKAGFYCSLYSNLDWLKNRLDDSRLKRFDHWLAQWASAPTYDGAFGMWQNSSKGSVNGISGNVDTDVAYKDYPAVIKGAKLNGFTGAGQTPSVPSQPEEPDPQLSASFKKGDLVKITGTKYYSGKTIPAWVKAKNWYVLQADGARVVIDRSEDGRNAICSPVNAADLKLVTAVPKKTVDELACEVIRGLWGNGADRRNRLTAAGYDYDAVQKRVNELLK

SEQ ID NO: 1104 - protein, 328 aa, Streptococcus agalactiae
MSNSSLVSIVNYSPNHSGRRNQPITKIAIHHTAGAVSAATIGNIFRPTSRQASCNYGIGNDNKIVLCVDESNRSWCTSSSWCDNRAITIEVANSSNGGNWPVSDRVLATLIDLVTDICKRNGIKNCTYTGGKDGVLQKHEWYANTNCPGPYLGSKFSYIASEVNKRLHGGSTSPSVAQGSSLYRVRKSWSDAKSQKGAFRNFENAKKCANANPGYSVYDANGRSVYPVASTTTKNIDTLAREVIAGNWGNGQDRVNRLTSAGYNYNAVQNRVNEIFSGSASKPTGKSIDTLAREVIRGDWGNGQDRKNRLERAGYDYNAVQRRVNELL

SEQ ID NO: 1105 - protein, 356 aa, Streptococcus pyogenes
MTIKGIDVSTWQGSIDFNRVKQSGINFVIIRAGYGSALSQKDKWYETNYARAKAAGLHVGAYWYSYAGSAGEAREEARVCKQVLSGKQFDYPIYFDIEEKSQLSRGRAFCDSLIRAFCNEMEAGGYLAGFYTSLSAALNYVSPDVRTRYAFWVAQWNSRCTYGGQYGLWQYSSSGSVPGIAGRCDMDLAYVDYPSIIKKGGFNGYGKGTSSAPARKSVDTLAHEVITGAWGNGEVRVNRLTKAGYDYDAVQARVNELLGIKPKKSIDTLAREVIRGDWGNGKDRVNRLTKAGYSYDAVQKRVNELLGTKPQKKAIDTMAREVIRGDWGNGADRKNRLAKAGYDYRAIQKRVNELLK

SEQ ID NO: 1106 - protein, 269 aa, unidentified
  REGION 1..269: note = Peptoniphilus lacrimalis DNF00528
MSNSPLVQARILSPNHSGRRNQKITKIAIHHAAGVINGRNLAGVFVPKSRRASANYNLGSDGVIVLGVDESNRAWTTSSSWCDNRAVTIEVGNSTRGPQWLISDYVLNRLIDLVTDICRRNGIYPCTYTGGKDGVLQKHEWYKSTNCPGPYLGSKFPYIANEVNKRLRGNNTVSKPTSGLYRVRKSWSEAKSQKGAFKNLDNAKRCADRFGLKVFDVNGKIVYPVGKTIDQLAREVISGKWGNGEERKRRLTKAGYDYKAVQRRVNQLL

SEQ ID NO: 1107 - protein, 269 aa, Anaerococcus hydrogenalis
MTYSKLVDDIILSPNNSGKRSEKISKIAIHHAGGIICGRDLARLFLPKSREASANYNLGSDGVLVLGVYEENRAWTTSSSWCDNRAITIEVGNSTRGPNWEISDFVLNKLIDLVTDICRRNNIYPCTYTGDKNGVLQKHFWYANTNCPGPYLGNKFSYIAKEVNKRLSKSENQNSNLYRVRNSFKDQKSQKGAFKSLENAKRCADKYKAKVFDYMGNEIYPRNNSKSIDQIAKEVIRGDWGNGNERKKRLEVAGYDYYAVQRRVNKILG

SEQ ID NO: 1108 - protein, 324 aa, Streptococcus agalactiae
SLVSIVNYSPNHSGRRNQPITKIAIHHTAGAVSAATIGQIFKPTSRQASCNYGIGNDNKIVLCVDESNRSWCTSSSWCDNRAITIEVANSSNGGNWPVSDRVLATLIDLVTDICRRNGIKNCTYTGGKDGVLQKHEWYANTNCPGPYLGSKFSYIASEVNKRLAGGSSNAPSTGGSSLYRVRKSWSDSKSQKGAFKNLDNAKKCANANPGYSVYDANGRSVYPVASTPTKNIDTLAREVLAGNWGNGQERVNRLTSAGYNYNAVQNRVNEILSGSASKPTGKSIDTLAREVIRGDWGNGQDRKNRLERAGYDYNAVQRRVNELL

SEQ ID NO: 1109 - protein, 286 aa, unidentified
  REGION 1..286: note = Oscillospiraceae bacterium
MSTATKYVPRLSAPSKTDKHWIKSTKGGLNICIEIKNGSVLPNCVGYAWGRFYEIIGTKPKLASLNAEDWYGNTSDGYERSSTPRLGAVACWRKGKVWNGTDGCGHVAIVEEIKKNGDIVCSNSAYGGTRFYMQTYLKSNGYNSGSLTFQGFILPPVDFSAQADTPPSAALSSTAFKIGDVVDFTGSTHYVSSTGTRGTAAKPGRAKITIIAPNTAHPYHIIAECGGGSTVYGWVNKSDIVPKKTIDELAQEVISGDWGNGDERKKRLTAAGYNYYAVQKRVNELL

SEQ ID NO: 1110 - protein, 300 aa, unidentified; identical to SEQ ID NO: 162
  REGION 1..300: note = Oscillospiraceae bacterium

SEQ ID NO: 1111 - protein, 328 aa, Anaerococcus vaginalis
MSNSSLVSIVNYSPNHSGRRNQPITKIAIHHTAGAVSAATIGQIFKPTSRQASCNYGIGNDNKIVLCVDESNRSWCTSSSWCDNRAITIEVANSSNGGNWPVSDRVLATLIDLVTDICRRNGIKNCTFTGGKDGVLQKHEWYANTNCPGPYLGSKFSYIASEVNKRLHGGSTSPSVTQSSSLYRVRKSWSDAKSQKGAFRNLENARKCANANPGYSVYDANGNSVYPVASTPSKSIDTLAREVIAGNWGNGQDRVNRLTSAGYNYNAVQNRVNEILSGSASKPTGKSIDTLAREVIRGDWGNGQDRKNRLERAGYDYNAVQRRVNELL

SEQ ID NO: 1112 - protein, 269 aa, Anaerococcus sp.
MTYSKLVDDIILSPNNSGKRSEKISKIAIHHAGGIICGRDLARLFLPKSREASANYNLGSDGVLVLGVYEENRAWTTSSSWCDNRAITIEVGNSTRGKNWEISDYVLNKLIDLVTDICIRNNIYPCTYTGDKEGVLQKHSWYANTNCPGPYLGEKFSYIAKEVNKRLRKNSSKNLNLYRVRNSFNDKKSQKGAFKSLENAKKCADKYKAKIFDERGNEIYPRKNIKSIDQIAKEVIRGDWGNGNERKKRLESAGYDYYAVQRRVNQILG

SEQ ID NO: 1113 - protein, 329 aa, unidentified
  REGION 1..329: note = Erysipelotrichaceae bacterium
MSNSSLVDMTILSPNHSGRRNQPITKIAIHHTAGAISAATIGNIFKPTSRQASCNYGIGNDNKIVLCVDEANRSWCTSSSWCDNRAITIEVANSSNGGNWPVSDRVLAKLIDLVTDICKRNGIKNCTYTGGKDGVLQKHEWYANTNCPGPYLGSKFSYIASEVNKRLSGNSSSSSAANTSSLYRVRKSWGDAKSQKGAFRSFENAKKCANVNSGYKVFDAKGNEVYPRKSTSSKSIDALAREVIAGNWGNGGERVNRLKSAGYDYNAVQNRVNEILSGKSSSYVGGKSIDTLAREVIRGDWGNGQDRKNRLERAGYDYNAVQRRVNELL

SEQ ID NO: 1114 - protein, 329 aa, unidentified
  REGION 1..329: note = Streptococcus phage Javan191
MSNSSLVNMTMLSPNHSGRRNQPITKIAIHHTAGAISAATIGHIFRPTSRQASCNYGIGNDNKIVLCVDEANRSWCTSSSWCDNRAITIEVANSSNGGNWPVSDRVLATLIDLVTDICRRNGIKNCTYTGGKDGVLQKHEWYAATNCPGPYLGSKFSYIASEVNKRLSGSSSSSGGASTSSLYRVRKSWSDAKSQKGAFRSLDNAKKCANANPGYSVYDANGNAVYPVISTPSKSIDALAGEVIAGNWGNGSDRVNQLISAGYDYDAVQNRVNEILSGKSSSQSGGKSIDTLAREVIRGDWGNGQDRKNRLERAGYDYNAVQRRVNELL

SEQ ID NO: 1115 - protein, 306 aa, unidentified
  REGION 1..306: note = Gardnerella phage vB_Gva_AB1
MSKKGIDVSEWQGDIDFNAVKASGVEFVIIRAGYGIGCKDKWFEQNYRKAKAAGLDVGAYWYSYANSGFEAAEEAQSCVNMLSGKSFEYPVYFDLEEKSQLNRGRAFCDSLITSFCNKLEACGYYAGFYTSLSTANNLVSAHVRDRYALWIAQWNTHCNYQGSYGLWQYSSSGSVPGVAGRVDMDYAYVDYPSIIKNAGLNGCKNGGSDQAARTSSIDEVAREVINGAWGNGNERKQRLTQAGYDYASVQNKVNELLGVKACRKSVDELAREVIRGTWGNGNERKNRLTQAGYDYDTVQKRVNELL

SEQ ID NO: 1116 - protein, 328 aa, unidentified
  REGION 1..328: note = Eubacterium sp. TM05-53
MDWKNLNADVNKILNKHYTKGRSGRKINKIIIHYNAGDLTVEGCYSVWQNRPASAHYQVESSGRIGQLVWDGDTAWHAGNWDANCSSIGIEHANKSGGYISEACLDAGAHLVAALCKYYGLGRPKWKVNVFPHNHFAATSCPGRLQDEQRDAYMQKAQQWYDQMVNGAEAPSKPSKPSTGNKKTNEEVAKEVVDGKWGNGDDRKNRLTKAGYDYNAIQSLVNQMIGGSKPAPKPTKTIAQLADEVIAGKWGNGDDRKNRLTKAGYNYDAVQAKVNEKLYGSKPSKSNEAIAKEVIAGKWGNGADRKKRLMDAGYNYDAIQNIVNRLCK

SEQ ID NO: 1117 - protein, 267 aa, Anaerococcus hydrogenalis
MTNSKLIDDIILSPNNSGLRNEKITKIAIHHAAGIIKGRDLAKIFLPRQRQASSNYMIGSDGLIVLGVDEKNRAWTTSSSWCDNRAITIEVGNSTRDPSWEVSDFVLNRLIDLVTDICRRNNIYPCTYTGNKNGVLQKHEWYANTNCPGPYLGNKFSFIASEVNKRLEKDYKENLYRVRKSFNDKKSQKGAFRSIDNAKKCADRYRLRVFDEGGNEVYPRENLKSIDTLAREVIRGDWGNGNERKKRLTDAGYDYYGVQRRVNKILS

SEQ ID NO: 1118 - protein, 306 aa, unidentified
  REGION 1..306: note = Gardnerella pickettii
MSKKGIDVSEWQGDIDFNAVKASGVEFVIIRAGYGIGCKDKWFEQNYRKAKTAGLDVGAYWYSYANSSSEAAEEAQSCVNMLSGKSFEYPVYFDLEEKSQLNRGRAFCDSLITSFCSKLETYGYYAGFYTSLSTANNLVSSHVRNRYALWIAQWNTHCSYQGSYGLWQYSSNGSVPGVAGRVDMDYAYVDYPSIIKNAGLNGYKNGGSYTAPQTSSIDDVAREVINGAWGNGNERKQRLTQAGYDYTSVQNKVNKLLGVKACRKSVDELAREVIRGTWGNGNERKNRLTQAGYDYDTVQKRVNELL

SEQ ID NO: 1119 - protein, 306 aa, Gardnerella vaginalis
MSKKGIDVSEWQGDIDFNAVKASGVEFVIIRAGYGIGCKDKWFEQNYRKAKTAGLDVGAYWYSYANSSSEAAEEAQSCANMLSGKSFEYPVYFDLEEKSQLNRGRAFCDSLITGFCSKLEACGYYAGFYTSLSTANNLVSAHVRNRYALWIAQWNTHCSYQGSYGLWQYSSNGSVPGVAGRVDMDYAYKDYPSIIKNAGLNGCKNGGSDQAARTSSIDEVAREVINGAWGNGNERKQRLTQAGYDYTSVQNKVNKLLGVKACRKSVDELAREVIRGTWGNGNERKNRLTQAGYDYDTVQKRVNELL

SEQ ID NO: 1120 - protein, 323 aa, unidentified; identical to SEQ ID NO: 161
  REGION 1..323: note = Ruminococcus sp. FC2018

SEQ ID NO: 1121 - protein, 287 aa, unidentified
  REGION 1..287: note = Streptococcus sp. 263_SSPC
MIKILRDFVMKDSGFLESFDFVVIHNDAGRIKPQRYISFLRNRDKALGIAHFYCNRDTIVQVVPIENIGYHTGDWWSNCRSVGYEVCESLSASDEEFLQNEDVTLLKAAADLVEAGMPISRETVRLHHEFVPTSCPHRSMELHGGTTESVRSYFIERMKYFASLGNNLIEILHNYFPEEKFHMKTWVRHEVFNNDNEIVQQVIRGEWGVGQERIKQLTEAGYNAERIQEKVNLALQGSQINDIKTMDALAYEVIQGDWGNGEERKERLEAAGYDYDAVQQRVNEILG

SEQ ID NO: 1122 - protein, 269 aa, unidentified
  REGION 1..269: note = Anaerococcus jeddahensis
MTYSKLVDDIILSPNNSGKRSEKISKIAIHHAGGIICGRDLARLFLPKSRGASANYNLGSDGIIVLGVYEENRAWTTSSSWCDNRAITIEVGNSTRGPNWEISDFVLDRLIDLVTDICRRNNIYPCTYTGDKEGVLQKHEWYANTNCPGPYLGEKFPYISKEVNKRLRKNPSKNSSLYRVRKSFKDIKSQKGAFKSLENAKRCADKYKEKVFDDMGNEIYPRKDHKSIDTLAREVIRGYWGNGNERKKRLTQAGYDYYAVQKRVNQILS

SEQ ID NO: 1123 - protein, 306 aa, unidentified
  REGION 1..306: note = Kallipyga gabonensis
MTIKGIDVSTWQGSIDFNRVKQSGINFVIIRAGYGSALSQKDKWFETNYARAKAAGLHVGAYWYSYAGSAGEAREEARVCKQVLSGKQFDYPIYFDLEEKSQLARGRAFCDSLIRAFCNEMEAGGYFAGFYTSLSAAVNNVSADVRNRYAFWVAQWNSRCTYQGQYGLWQYSSSGSVPGIAGRCDMDLAYVDYPSIIRKGGFNGYGKGTSSAPARKSVDTLAHEVISGAWGNGDDRVNRLTKTGYDYDAVQARVNELLGIKPKKSIDALAREVIRGDWGNGKDRVNRLTKAGYDYNAVQKRVNELL

SEQ ID NO: 1124 - protein, 269 aa, unidentified
  REGION 1..269: note = Anaerococcus rubeinfantis
MTYSKLVDDIILSPNHSGKRSEKISKIAIHHAGGIICGRDLARIFLPKSRGASANYNLGSDGILVLGVYEENRAWTTSSSWCDNRAITIEVGNSTRGPNWEISDFVLDRLIDLVTDICMRNNIYPCTYTGDKEGVLQKHEWYANTNCPGPYLGKKFSYIANEVNKRLRKNPRKNSNLYRVRNSFKDQKSQKGAFKSLENAKRCADKYKVKVFDERGNEIYPRKNIKSIDQIAKEVIRGEWGNGNERKKRLTHAGYDYYVVQRRVNQILS

SEQ ID NO: 1125 - protein, 328 aa, Streptococcus pyogenes
MSNSSLVSIVNYSPNHSGRRNQPITKIAIHHTAGAISAATIGQIFKPTSRQASCNYGIGNDNKIVLCVDESNRSWCTSSSWCDNRAITIEVANSSNGGNWPVSDRVLATLIDLVTDICRRNGIKNCTYTGGKAGVLQKHEWYANTNCPGPYLGSKFPYIASEVNKRLAGGSSNAPSTGVSSLYGVRKSWSDAKSQKGAFKNLENAKKCVNANPGYSVYDANGRSVYPVASTPTKNIDTLAREVIAGNWGNGQDRVNRLTSAGYNYNAVQNRVNEILSGSASKPTGKSIDTLAREVIRGDWGNGQDRKNRLERAGYDYDAVQKRVNEIL

SEQ ID NO: 1126 - protein, 328 aa, unidentified
  REGION 1..328: note = Bacillota
MSNSSLVSIVNYSPNHSGRRNQPITKIAIHHTAGAISAATIGQIFKPTSRQASCNYGIGNDNKIVLCVDESNRSWCTSSSWCDNRAITIEVANSSNGGNWPVSDRVLATLIDLVTDICRRNGIKNCTYTGGKAGVLQKHEWYANTNCPGPYLGSKFPYIASEVNKRLAGGSSNAPSTGVSSLYRVRKSWSDAKSQKGAFKNLENAKKCVNANPGYSVYDANGRSVYPVASTPTKNIDTLAREVIAGNWGNGQDRVNRLTSAGYNYNAVQNRVNEILSGSASKPTGKSIDTLAREVIRGDWGNGQDRKNRLERAGYDYDAVQKRVNEIL

SEQ ID NO: 1127 - protein, 327 aa, unidentified
  REGION 1..327: note = Streptococcus sp. HMSC073A12
MSNSSLVSIVNYSPNHSGRRNQPITKIAIHHTAGAVSAGTIGQIFKPTSRQASCNYGIGNDNKIVLCVDESNRSWCTSSSWCDNRAITIEVANSSNGGNWPVSDRVLATLIDLVTDICRRNGIKNCTYTGGKDGVLQKHEWYANTNCPGPYLGSKFPYIASEVNKRLAGGSGSSNTGTSSLYRVRKSWADAKSQKGAFRNLENAKKCAKANPGYSVYDANVNAVYPVSNAPSKSIDTLAREVIAGNWGNGQDRVNRLRVAGYDYNAVQNRVNEILSGSASKPTGKSIDTLAREVIRGDWGNGQDRKNRLERAGYDYDAVQKRVNEIL

SEQ ID NO: 1128 - protein, 306 aa, unidentified
  REGION 1..306: note = Gardnerella swidsinskii
MSKKGIDVSVWQGDIDFNAVKASGVEFVIIRAGYGIECKDKWFEQNYRKAKTAGLDVGAYWYSYANSGFEAAEEAQSCVNMLSGKSFEYPVYFDLEEKSQLNRGRAFCDSLITSFCNKLESCGYYAGFYTSLSTANNLVPAHVRNRYALWIAQWNTHCDYQGSYGLWQYSSSGSVPGVAGRVDMDYAYVDYPSIIKNAGLNGYKNGESHQATRTTSIDEVAREVINGAWGNGNERKQRLTQAGYDYASVQNKVNELLGVKACRKSVDELAREVIRGTWGNGNERKNRLTSAGYDYDTVQKRVNELL

SEQ ID NO: 1129 - protein, 269 aa, unidentified
  REGION 1..269: note = Peptoniphilus vaginalis
MSNSPLVQARILSPNHSGRRNQEITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKRLRENKNVSNPTGGIYRVRKSWSDIKSQKGAFKNLENAKRCADRFGLKVFDANGKIVYPVGKTIDQLAREVISGKWGNGEERKRRLTQAGYDYYAVQRRVNSML

SEQ ID NO: 1130 - protein, 306 aa, Gardnerella vaginalis
MSKKGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCSKLETYGYYAGFYTSLSVANNLVSAHVRNRYALWIAQWNTHCNYQGSYGLWQYSSSGSVPGVAGRVDMDYAYVDYPSIIKNAGLNGCKNGGSDQAARTSSIDEVAREVINGAWGNGKERKQRLTQAGYDYASVQNKVNELLGVKAYRKSVDELAREVIRGAWGNGNERKQRLTQAGYDYDTVQKRVNELL

SEQ ID NO: 1131 - protein, 328 aa, Streptococcus anginosus
MSNSSLVNMTMLSPNHSGYRNQPITKIAIHHTAGAISAATIGQIFKPTSRQASCNYGIGNDNKIVLCVDESNRSWCTSSSWCDNRAITIEVANSSNGGNWPVSDRVLATLIDLVTDICRRNGIKNCTYTGGKDGVLQKHEWYANTNCPGPYLGSKFSYIASEVNKRLAGGSSNAPSTGGSSLYRVRKSWSDAKSQKGAFKNLDNAKKCANANPGYSVYDANGNSVYPIASAPSKSVDILAREVLAGNWGNGQDRVNRLTSAGYDYNSVQNRVNEILSGGSNSPSGKSIDTLAREVIRGDWGNGQNRKNRLERAGYDYNAVQRRVNELL

SEQ ID NO: 1132 - protein, 328 aa, Streptococcus agalactiae
MSNSSLVSIVNYSPNHSGRRNQPITKIAIHHTAGAVSAATIGQIFKPTSRQASCNYGIGNDNKIVLCVDESNRSWCTSSSWCDNRAITIEVANSSNGGNWPVSDRVLATLIDLVTDICRRNGIKNCTYTGGKDGVLQKHEWYANTNCPGPYLGSKFSYIASEVNKRLAGGSSNAPSTGGSSLYRVRKSWSDSKSQKGAFKNLDNAKKCANANPGYSVYDANGRSVYPVASTPTKNIDTLAREVLAGNWGNGQERVNRLTSAGYNYNAVQNRVNEILSGSASKPTGKSIDTLAREVIRGDWGNGQDRKNRLERAGYDYNAVQRRVNELL

SEQ ID NO: 1133 - protein, 328 aa, unidentified
  REGION 1..328: note = Bacillota
MSNSSLVSIVNYSPNHSGRRNQPITKIAIHHTAGAISAATIGQIFKPTSRQASCNYGIGNDNKIVLCVDESNRSWCTSSSWCDNRAITIEVANSSNGGNWPVSDRVLATLIDLVTDICKRNGIKNCTYTGGKDGVLQKHEWYANTNCPGPYLGSKFSYIASEVNKRLAGGSSNAPSTGGSSLYRVRKSWADAKSQKGAFRNLDNAKKCADANPGYSVYDANGNSVYPVASDPSKSVDTLAREVIAGNWGNGQDRVNRLTSAGYNYNSVQNRVNEILSGGSNKPTGKSIDTLAREVIRGDWGNGQDRKNRLERAGYDYNAVQRRVNELL

SEQ ID NO: 1134 - protein, 329 aa, Streptococcus canis
MSNSSLVNMTMLSPNHSGRRNQPITKIAIHHTAGAISAATIGQIFRPTSRQASCNYGIGNDNKIVLCVDEANRSWCTSSSWCDNRAITIEVSNSSNGGNWPVSDRVLATLIDLVTDICKRNGIKNCTYTGGKDGVLQKHEWYANTNCPGPYLGSKFSYIASEVNKRLSGNISSSGGASTSSLYRVRKSWSDAKNQKGAFRSFDNAKKCANSNSGYKVYDSNGNEVYPNKSTSSKSIDTLAREVIAGNWGNGSDRVNRLTSSGYDYDAVQNRVNEILSGKSSSQSDGKSIDTLAREVIRGDWGNGQDRKNRLERAGYDYNAVQRRVNELL

SEQ ID NO: 1135 - protein, 332 aa, unidentified; identical to SEQ ID NO: 165
  REGION 1..332: note = Amedibacterium intestinale

SEQ ID NO: 1136 - protein, 329 aa, Streptococcus equi
MSNSSLVDMTILSPNHSGRRNQPITKIAIHHTAGAISAATIGNIFKPTSRQASCNYGIGNDNKIVLCVDEANRSWCTSSSWCDNRAITIEVANSSNGGNWPVSDRVLATLIDLVTDICRRNGIRNCTYTGGKDGVLQKHEWYANTNCPGQYLGSKFSYIASEVNKRLSGNSSSSGGANTSSLYRVRKSWGDAKSQKGAFRSFENAKKCANVNSGYKVFDAKGNEVYPRKSTSSKSIDALAREVIAGNWGNGGERVNRLTSAGYDYNAVQNRVNEILSGKSSSHVSGKSIDTLAREVIRGDWGNGQDRKNRLERAGYDYNAVQRRVNELL

SEQ ID NO: 1137 - protein, 327 aa, Streptococcus anginosus
MSNSSLVSIVNYSPNHSGRRNQPITKIAIHHTAGAVSAGTIGQIFKPTSRQASCNYGIGNDNKIVLCVDESNRSWCTSSSWCDNRAITIEVANSSNGGNWPVSDRVLATLIDLVTDICRRNGIKNCTYTGGKDGVLQKHEWYANTNCPGPYLGSKFPYIASEVNKRLAGGSGSSNTGTSSLYRVRKSWADAKSQKGAFRNLENAKKCAKANPGYSVYDANGNAVYPVSNAPSKSIDTLAREVIAGNWGNGQDRVNRLRVAGYDYNAVQNRVNEILSGSASKPTGKSIDTLAREVIRGDWGNGQDRKNRLERAGYDYDAVQKRVNEIL

SEQ ID NO: 1138 - protein, 328 aa, Enterococcus faecalis; identical to SEQ ID NO: 156

SEQ ID NO: 1139 - protein, 267 aa, Anaerococcus hydrogenalis
MTNSKLIDDIILSPNNSGLRNEKITKIAIHHAAGIIKGRDLAKIFLPRQRQASSNYMIGSDGLIVLGVDERNRAWTTSSSWCDNRAITIEVGNSTRGVNWEVSDFVLNRLIDLVTDICRRNNIYPCTYTGNKNGVLQKHEWYANTNCPGPYLGNKFSFIASEVNKRLDKDYKENLYRVRKSFNDKKSQKGAFKSIDNAKKCADRYRLRVFDEGGKEVYPRENLKSIDTLAREVIRGDWGNGNERKKRLTDAGYDYYGVQRRVNKILS

SEQ ID NO: 1140 - protein, 321 aa, Granulicatella adiacens
MIQIIKDYVMEDSGDLVDFQFVVIHNDAGRMRPQKYIDFLRWRDKTLGIAHYYCNRKEIVQVVPKTNIGYHTGDWWSNCRSIGYEVCESLSANDQDFIQNEDVALMKATVDLLEAGLPINKETVRLHHEFVPTSCPHRSMELHGGTTESVKEYFIERMQYFASLGDALPYILYELGERKTLCVREYKRIWNTKKSPTMFDKTLIEEIIRGDWGNGDERANRLLNAGYNPVKVQTAVNRFLVGEDWENSISEDENNEWKQEESEKNSDYTETGWSNNVQNIDSIAAEVIQGDWGNGEERRERLEQAGYDYDAVQARVNEMLE

SEQ ID NO: 1141 - protein, 190 aa, unidentified
  REGION 1..190: note = Gardnerella sp. Marseille-Q2328
NKLEACGYYAGFYTSLSTANNLVSSHVRDRYALWIAQWNTHCSYQGSYGLWQYSSSGSVPGVVGRVDMDYAYVDYPSIIKNAGLNGCKNGGSDQAARTTSIDEVAREVINGAWGNGSTRKQRLTSAGYDYASVQNKVNKLLGVKACRKSVDELAREVIRGTWGNGNERKQRLTQAGYDYDTVQKRVNELL

SEQ ID NO: 1142 - protein, 216 aa, Abiotrophia defectiva
MGQADKLIRVAQSYLGTSQWSDDHLAMVDAYNSVSPIPVGYRVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWDHEAIAGYARPRYDQEGQESAPASSEDTSPNDDLITAVAWDVIRGEYGNGEERVRELTEAGYDYQAVQDRVNQLLS

SEQ ID NO: 1143 - protein, 216 aa, Abiotrophia defectiva
MGQADKLIRVAQSYLGTSQWSDDHLAMVDAYNSVSPIPVGYAVQYGDDWCDIFVTVCGDEAGLSHLIGRECGVPRHLAWFQEQGIWLGQAWPQAGDIVIFNFDGGPVDHIGIVERVQADGSISTIEGNYNGRVARAYYDWNHEAIEGYARPRYDQDSQESAPASSEDTSPSDDLITALAWDVIRGEYGNGEERVRELTEAGYDYQTVQDRVNQLLS

SEQ ID NO: 1144 - protein, 216 aa, Abiotrophia sp.
MGQADKLISIAQSYLGTSQWSDDHLAMVDAYNSVSPIPVGYAVQYSDDWCDVFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYARPRYDQEGQESAPASSEDTSPSDDLITAVAWDVIRGEYGNGEERVRELTEAGYDYQAVQNRVNQLLS

SEQ ID NO: 1145 - protein, 267 aa, Anaerococcus hydrogenalis
MTNSKLIDDIILSPNHSGLRNEKITKIAIHHAAGIIKGRDLAKIFLPRQRQASSNYMIGSDGKIILGVDETNRAWTTSSSWCDNRAITIEVGNSTRGVNWEVSDFVLNRLIDLVTDICRRNNIYPCTYTGNKNGVLQKHEWYANTNCPGPYLGNKFAFIASEVNKRLDKDYKEDLYRVRKSFSDKKSQKGAFKSIDNAKKCADKYRLRVFDEGGNEIYPRKNFKLIDTLAREVIRGDWGNGNERKKRLTDAGYDYYGVQRRVNQILS

SEQ ID NO: 1146 - protein, 306 aa, unidentified
  REGION 1..306: note = Fannyhessea vaginae
MSKRGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRVFCDSLITSFCNKLEACGYYAGFYTSLSTANNLVSAHVRDRYALWIAQWNTHCNYQGSYGLWQYSSSGSVPGIAGRVDMDYAYKDYPSIIKNAGLNGCKNGGSNQAARTSSIDEVAREVINGAWGNGNERKQRLTSAGYDYASVQNKVNELLGVKACRKSVDELAREVIRGTWGNGNERKNRLTQAGYDYDTVQKRVNELL

SEQ ID NO: 1147 - protein, 216 aa, Abiotrophia defectiva
MGQADKLISVAQSYLGTSQWSDDHLAMVDAYNSVSPIPVGYAVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYARPRYDQEGQEPAPASLEDTSPSDDLITAVAWDVIRGEYGNGEERVRELTEAGYDYQAVQDRVNQLLS

SEQ ID NO: 1148 - protein, 267 aa, Anaerococcus hydrogenalis
MTNSKLIDDIILSPNHSGLRKQKISKIAIHHAAGIIKGRDLAKIFLPRQRQASANYNLGSDGVIVLGVDERNRAWTTSSPWCDNRAITIEVGNSTRGPNWEISDFVLDRLIDLVTDICKRNNIYPCTYTGNKNGVLQKHEWYASTNCPGPYLGNKFSYISKEVNKRLCKNNISNLYRVRKSFKDVRSQKGAFKSIDNAKRCADKYRLRVFDEGGNEVYPRKNLKSIDTLAREAIRGDWGNGNERKKRLTKAGYDYYAVQRRVNQILI

SEQ ID NO: 1149 - protein, 326 aa, Finegoldia magna
MSNSPLVQAKILSPNHSGRRNQKITKIAIHHAAGVIGGKNLASVFIPRSRQASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLKGNKTVSRPVGGLYRVRKSWSDVKSQKGAFKNLDNAKKYADANPGYSVYDAKGRSVYPVVSAPSKSVDTLAREVITGNWGNGQDRVNRLTSAGYDYNSVQNRVNEILSGGGKKPRGKSIDTLAREVIRGDWGNGQDRKNRLERAGYDYNAVQRRVNELL

SEQ ID NO: 1150 - protein, 332 aa, unidentified
  REGION 1..332: note = Catenibacterium sp. RTP21428st1_D7_RTP21428_210409
MSNSNLVSYTRLSPNHSGRRTHAIDRITPHCVVGQCSVETLGNIFAPTSREASCNYGIGVDGRVGMYVEEKNRSWCSSSNSNDQRAVTIECASDTKHPYWMNDKVYSTLIKLCVDICKRNGKKKLIWFGDKNKTLNYSPKSDEMVLTVHRWFANKTCPGDWLYSRLGELAKKVTAQLGGSSVTPSKSLYRVRKSWSNVKSQKGAFKSLDNAKRCADSHKGYFVFDERGNIVYPKSNKKSIDELAREVIKGLWGNGSDRKNKLTSAGYDYDAVQSKVNEILDGGKATPTKSIDTLAKEVIRGDWGNGTDRKKRLTAAGYNYDAVQNRVNQILG

SEQ ID NO: 1151 - protein, 332 aa, unidentified; identical to SEQ ID NO: 1150
  REGION 1..332: note = Caudoviricetes sp.

SEQ ID NO: 1152 - protein, 283 aa, Streptococcus anginosus
KPTSRQASCNYGIGNDNKIVLCVDESNRSWCTSSSWCDNRAITIEVANSSNGGNWPVSDRVLATLIDLVTDICRRNGIKNCTYTGGKDGVLQKHEWYANTNCPGPYLGSKFTYIASEVNKRLHGGSTSPSVTQSSSLYRVRKSWSDAKSQKGAFRNFENAKKCANANSGYSVYDANGRSVYPVTSSQSKSIDTLAREVIAGNWGNGQDRVNRLTSAGYNYDAVQDRVNEILSGNASKPAGKSIDTLAREVIRGDWGNGQDRKNRLERAGYDYTAVQRRVNELL

SEQ ID NO: 1153 - protein, 313 aa, unidentified
  REGION 1..313: note = Clostridium sp. AM29-11AC
MAYTNSSLVSYTNLSPNHSGLKTHSIDRITPHCVVGQLSAESICGCFTSPSREASCNYGIGKDGKIALCVEEKNRSWCSSSSANDQRAVTIECASDLHHPYAMTTAVYNSLVKLCTDICKRNGKKKLLWLGDKNKTLNYSPKSDEMVLTVHRWFANKSCPGDWLYGRLGDLAAKVTAQLGEMAADSGGTLYRVQTGAFSKKSNADALEEKLKARGFDTYMVPSGGFYKVQVGAYSIRANAETMMEKVKAAGFDAFITTASGSAVSSSNAKSIDTLAREVIRGDWGNGAERKQRLSAAGYDYAAVQQRVNELLS

SEQ ID NO: 1154 - protein, 328 aa, Streptococcus anginosus
MSNSRLVDMTMLSPNHSGHRNQPITKIAIHHTAGAISAATIGNIFRPTSRQASCNYGIGNDNRIVLCVDEANRSWCTSSSWCDNRAVTIEVSNSSNGGNWPVSDRVLATLINLVTDICRRNGIRNCTYTGGKDGVLQKHEWYAATNCPGPYLGSKFPYIAAEVNKRLAGGSNGSVNTGTSSLYRVRKSWSDAKSQKGAFRNLENAKKCVNANPGYSVYDANGNSVYPVASAPSKSVDTLAREVLTGNWGNGQDRVNRLTSAGYDYNSVQNRVNEILSSGSNSPSGKSIDTLAREVIRGDWGNGQDRKNRLERSGYDYHAVQRRVNELL

SEQ ID NO: 1155 - protein, 367 aa, unidentified
  REGION 1..367: note = Arthrobacter phage Shepard
MALPITGINEQFNAVFFTEGPTQKDGIVIHWWGLPQGQTIQSVRDTFGNGGRQASAHYGCSDGVVDCYVNPDDVAWANGHWGANLSKISIECDPRQSDGDYYAAAWTVAYIRSIYGDLPLSRHDQYYATQCCGTYDINRIDRLARTIDVKSVSKPTPAKPAPAKPAVPATKGKTIAQLAEEVLKGAYGTGDARRLALGAQFQAVQDEVNRRLSGAANPKPKPNISALADQVLAGKFGNGDQRITALGVNYQAVQDEVNRRANAKPAAKPAAKPAPKPAAKPVVTVVNISDLVRRTLNGEFGNGDERKRRLGANYQAVQNAINAGAQPNINDLVARTLRGDFGDGDERKRRLGLNYSAVQAEINRRYS

SEQ ID NO: 1156 - protein, 350 aa, unidentified
  REGION 1..350: note = Caudoviricetes sp.
MSMKFIDISNWQAGLDVVKVVSNGSLGGVVVKATEGLGYIDKSCDEFVQQCIGSDIPFGFYHFARNNDANAEAEFFRKNTIGYEGKGIPILDWEAGQSVSWVNAFVEHYHDITGVWPWIYANPWRFEQGEVNSNCGRWVAGYPKDGITDIDYGISNSLPSSYNVGLVCAWQFSSSVRISGYNGSLDGNVFYGSSEAWAKYVGSSPSSPSDGDEPSGDAAPNGTTLELAIAVMNGSYGNGDERKKRLGSRYDEVQSFINHIAAASNETLASEVKDGKYGNGNDRKLILGDRYDNVQAIVNGMSGTTYYVVKAGDTLSGIASKYGTTYQRLASMNGISNPNKIYVGQKIRVR

SEQ ID NO: 1157 - protein, 300 aa, unidentified
  REGION 1..300: note = Clostridia bacterium
MSKFGIDVSKHQSKIDWEKAKDKIEFAIIKLGNIFQNDTNNVDEQFERNYSECKRLGIPVGVYVYNYAKTTDKVQAGANFVVEKLKGKTLELPVYIDMEDSRIAPLGKERLTQICIEFNTIIEKAGYWAGVYANRNWYDNYLNKEEIKKRYTTWIATYTSGTDKYKGEYDIWQNSSTGKIDGINGNVDTNYMHRDLISEIKGNTTQTTKSIVDLANEVIAGKYGDGEERKKALGSLYDEVQAKVNEIKKVKKEVGRTYTVKKGDTLSAIAKKYNTTSQAIAQKNNISNINKIYVGQVLKI

SEQ ID NO: 1158 - protein, 247 aa, unidentified
  REGION 1..247: note = Clostridium sp. CAG:914
MSLRNRVLESKELEITQNYKKGYHDGIDVVNKNYTLGNIVAHSNGIVISYRNDCNGFENGSYGNYVKIKHNNGYYTLYAHMAYNSVKVKEGQNVTKGQVLGYMGNTGMSYGGHLHFEVRNTSDIRIDPTSYLNSDLPNINKTIEELVKEVIEGKWGNGEERKRRLGDKYIEVQTRVNEKLQSKTKYLYNPNYKGNSIVDGLKEISIDSSFNYRKKLAKINNINNYIGSAEQNTTLLNLLKKGKLIDA

SEQ ID NO: 1159 - protein, 303 aa, unidentified
  REGION 1..303: note = Siphoviridae sp. ct8M020
MNGFDISSHQTGIDLSKIDCDFIITKATEGYYYTNPDFVRSFEQGIATGKRMGIYHYANGTDPIREAKFFLKKIEPYLGKAILCLDWERSNNRSYGYNDADWCMRFMDYVYDTVGIKMFLYISAGLRHKFQKVLDKYYFWAAQYADFSPVYKFQEHPWNEGAYECEIRQYTSCFWMPGIWRSRLDTNKAYITPEQWDAMAAPLQEVPEDPAESKYTTDELAQQVLNGKWGNGGERRRLLEEAGYNYEEVQARVNAILADENITRLAREVIAGKYGNGNERREKLGEMYQPVQKRVNQLLGYRC

SEQ ID NO: 1160 - protein, 591 aa, unidentified
  REGION 1..591: note = Caudoviricetes sp.
MQGTKTGTSKYPFSKLKKGAKLGIILFLVLSLTLYTFLYTISDYKNMPYFVYKFIYVITQRERRNEIMLLDTDKQKFVDDIAKYVQKYAGSYGISVHSPIIAQAILESGWGKSRLATDYHNYFGMKCGTKWTGPSVNMTTQEEYTAGTLATIKDNFRVYDNMENGVKGYFEFIQLSRYENLKGIVNPQKYIETIKNDGYATSSTYVDSLMQIIKIYNLTSYDSTESVEGEDIMGSRQAMIAKMQSWIGKNEVDGSFREIIDIYNSHTPRARGYKLQYSDEWCAGTVSAAAIATGNTNAVPLEVSCHYMIEGAKAKGIWVENDSYVPQGGDIILYDWQDSGIGDNTGNPDHVGVVEYTSGGIIHVIEGNNGEKVARRELSVNGRYIRGFIVPKYSDNVAPSGGVTPTVSGTIDELARRVIAGEFGSGDARKNVLGDKYDAVQARVNEILSGTASTPSKSVSEVAKEVLAGSWGNGSDRKAKLEAAGYNYDEVQSAVNALCNKPTLKSVSEIAKEVLAGKWGNGTDRKNKLTAAGYNYNEVQAAVNSLNKKSVTTIAKEVIAGKWGNGSDRKKKLESAGYNYNEVQKEVNRLL

SEQ ID NO: 1161 - protein, 287 aa, unidentified
  REGION 1..287: note = Bacteriophage sp.
MMRLAEMQKVIDVSYHNGVIDWERVKSAGYHAIIRCGYGSNFENQDDEQFKRNADECVRLNIPFGCYLYSYAKGATQAISEAEHAIRLCAPYRDVMAYPLFFDTEEPGTETVSQAHATIFCSRVKAAGFVPGIYASQAWWQENLPNVNGCVKWVARWSASEPIVNGWQLWQYSERGNVPGVTVKVDLNYSRYEIGSHGAISIVDDLASEVIAGKYGNGEERKRKLGARASVVQLIVNRKLTGKWTGIDVVAREVIAGKWGNGTARRGNLGSAYDVVQKRVNELLKQK

SEQ ID NO: 1162 - protein, 532 aa, unidentified
  REGION 1..532: note = Caudoviricetes sp.
MDTAPQGRQGCENGGRRPTARRRTRPALLQVAPDPAGNRLRGRRVRCGNETDRAKGLQRLSRLGRQRRRHADEGRHPSRQDRTSQPIRRRMTPTHDSRPRATRGLFISNDKRRKDMVKHKPPWKALTAALLAVFMAVAPAASADMNGYDVSGYQSGDITAAAPADFVVIKATQGLGWSNINYSAQVANADRTGKATGMYHFANGGNAVAEADVFVNAVSDRVGRSVLALDWEQCLAYGRYGCSVTNPNWGNPAWIQTWVTRVHDRTAVWPIVYIQRSAVWQVNAWVRARCMLWVAQYASNAATGYQSNPWNAGVSGEGMIQYTSSGYVGGRGPLDLNRFFGNRQAWQKIACGERAGCNCGTVTPAPTTRTETTTTTTDLNALATAVIRGDYGNGADRQARLGGNYAAVMAIVNARLGGGSYSGPATVTTTTTRTYVVQAGDTVWAIAERTGLKPASAWRVPSGNINLIYTGQVITYYGTTATTTASGYYGSSTHVVRAGESLWFIYGTGWASAAARNGIHAPYVIYPGQRLR

SEQ ID NO: 1163 - protein, 374 aa, unidentified
  REGION 1..374: note = Caudoviricetes sp.
MRVLWGYHSRQLSPRLLIFYRKRQKVRANNMMKGMDISKWQGAVDFAKVAASGIQFVILREGYRQAVDGKFFEYVNGCRANNIPVKGVYHFSYALNADQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYVAVQARVNALM

SEQ ID NO: 1164 - protein, 421 aa, unidentified
  REGION 1..421: note = Caudoviricetes sp.
MRKHKPPWLKRIRLAATGAAMAIIMAVAPAAMADLNGVDISGYQSSDIPSAISADFIIVKATQGLYWSNNNYATQLANADRTGKETSVYHFANGGNATAEADTFVNAVAGRVGRSILALDWEQCLAYGRYGCATVNPNWGNPAWIQTWVTRVHDRTQVWPIVYVQRSAVWQVNTWVRQRCMLWVAQYATTAPTGYQSSPWNGGVSGEGMTQYSSTGYINGRGPLDLNRFYGDRTAWRKIACGERRGCSAGTVTPAPQVDKPAEQTPTDLNVLADKVIHGDYGNGQERINRLGGNYNAVMAIVNSKLGGGSSAQTTVTRTTTRTYVVRSGDTVSAIAERTGLKPASAWRVPSGNINRIYVGQTITYYGSAATTAASDYYGSATHVVRSGESLWSIYGSGWASAAARNGLRPPYTIYPGQRLR

SEQ ID NO: 1165 - protein, 484 aa, unidentified
  REGION 1..484: note = Caudoviricetes sp.
MGINIEAAIAWMSARAGKVTYSMDYRNGPNSYDCSSSVYFALMSAGAISAGWAVNTEYEHDWLIKNGYTLVAEDQDWDSKRGDIFIWGQRGQSSGAGGHTGIFIDPDNIIHCNYAHNGITVNNYNQTAAASGWMYCYVYRLTNQASTPSTSPLGKDLDTLVRETLAGKYGNGDTRKAALGNQYEAVMAVINGKATAPKKTIDQLAQEVIQGKHGNGEERKKALSSDYDAVQKRVTEILKGSTSGNASKTPSDAPKSEVVNSSTEPKTGETGATGKATDTKITKEDGDLSFNGAILKKTVLDVILAKCKEHNILPSYAITVLHFEGLWGTSAVGKADNNWGGMTWTGKGERPSGVTVTQGSARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1166 - protein, 246 aa, unidentified
  REGION 1..246: note = Caudoviricetes sp.
MEIIETNLQFNSNHSPMKKVEGIALHHSGVTVLQSVEVIHNYHKSKGWAGIGYHYYVRKDGSVYRGRPENMAGAHCPGVNSISIGICAEGNFSEETMSNVQKQALIELVKDIKSRYDIKWIKGHREITSTSCPGDNFPLEEIKNVIASVETPQTTNSIEELAQKVIAGEYGNGEERKQKLGSLYNEVQNKVNEILSGKSSTTKSNEELANEVIEGKWGNNPERKQKLLEAGYNYDAIQKLVNQKLK

SEQ ID NO: 1167 - protein, 250 aa, unidentified
  REGION 1..250: note = Caudoviricetes sp.
MDKESFIQKVAEKVRKYAPLYGIEVHSPIIAQAILESGWGSSVLASKYNNYFGLKCGGAWNGKSVNMQTSEEYEVGVHTQIRDNFRVFDDFDAGIRGYFEFINYSRYANLKGVTSPEEYCRRIKADGYATSSTYVDNLMRVIRENNLTRFDNSDEPQEDVNIEDLAHRVIKGEFGNGEERKALLGSNYEKVQQRVNELMGATTPKYDIEDLATRTIRGEFGNGSARKEALENMEPGLYAKVQKRVNEMLS

SEQ ID NO: 1168 - protein, 410 aa, unidentified
  REGION 1..410: note = Caudoviricetes sp.
MRKHKPPWLKRFRLAVTGVVMAIAMVVAPAAMADLNGYDVSGYQAPDITQIAPADFAIVKVNQGWYINGSWGQQAAGAVNTGKELGLYDYASGMDATTEADNFVNHITGYVGKAMLVLDWEPYQNAAWGNSNWVRTWVYRVHARTGVWPVVYCSKGFVGQIPADIRAKCMLWAAQYANNYATGYQDSPWLAGSQGEGMLQYTSTGYLNGRGPLDLDRFFGDRTAWRKIACGERAGCSTTGGSTGTPNVHVEKRTTNTTDLNALATAVIRGDYGNGADRQARLGDNYQAVMNIVNSRLSGSTYPGPTTVTRTYVVRSGDTVSAIAERTGLKPASAWRVPSGNINRIYVGQTITYYGSSATSTPSKTYYGSSTHVVSAGESLWKIYGAGWYAAAQRNGIRPPYTIYPGQRLR

SEQ ID NO: 1169 - protein, 299 aa, unidentified
  REGION 1..299: note = Caudoviricetes sp.
MDKQTFISQIAAYVIKYAAQYGIKVHSPIIAQAILESGWGQSSLAAKYHNYFGLKCGSAWTGKSVNMATSEEYTPGVHTNIRDNFRVFDSMEDGVKGYFDFINYSRYANLKGVTDPQTYVENIKADGYATSSTYVTNLMRVIRDNNLTQYDGAAQQTPSKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGTDRKNRITAEGYDYAAVQARVNALM

SEQ ID NO: 1170 - protein, 481 aa, unidentified
  REGION 1..481: note = Streptococcus equi subsp. zooepidemicus
MTVNIETAIAWMSARAGKVTYSMDYRNGPGSYDCSSSVYYALMSAGAISAGWAVNTEYEHDWLIKNGYKLIAENQDWDAKRGDVFIWGKRGQSSGAGGHTGIFIDPDNIIHCNYARNGITVNNYNQTAAASGWMYCYVYRLANQPSNSTTGKSLDTLVKETLAGVYGNGDTRKAALGNQYEAVMAVINGKTTVPKKTIDQLAQEVIQGKHGNGEERKKSLGSQYEAVQKRVTEILKSSPSGNAPKTPSGTLKSEVVNSSTEPKTEETGATGKVTELKIAKEVGDLSFNGAILKKSVLDVILAKCKEHNILPSYAITVLHFEGLWGTSAVGKADNNWGGMTWTGKGERPSGVTVTQGTARPTNEGGHYMHYSSVDDFLTDWFYLLRADGSYKVSGAKTFSEAVKGMFKVGGAVYDYAASGYDNYIVGMSSRLKAIEAENGSLSKFDVGTVDNVGSTDKIEVNIEGIEISINGIIYTISKKPV

SEQ ID NO: 1171 - protein, 324 aa, Streptococcus suis
EQLVKETLAGVHGNGDARKASLGNQYEPVMAVINGKATALKKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1172 - protein, 473 aa, Streptococcus suis
MTINLETSIRWMNDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLEQLVKETLAGVHGNGDARKASLGNQYEPVMAVINGKATALKKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1173 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLEQLVKETLAGVHGNGDARKASLGNQYEPVMAVINGKATALKKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1174 - protein, 284 aa, Streptococcus suis
KKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1175 - protein, 483 aa, Streptococcus suis
MSLNMEQAIAWMEARRGKVTYSMDYRNGPNSYDCSSAVYYALLSAGAIPPGWVVNTEYEHDWLLKIGFKLIAENSAFSAKRGDIFIWGKKGQSAGAGGHTGIFVDSNNIIHCNYARNGITVDGYLNVARASGSKYAYIYRPPAQSTVPTSTARKSIDQLVQETLAGKYGNGEQRKASLGNQYQSVMAVINGKASAPKKTVDQLAQEVIAGKHGNGDERKKSLGSDYDAVQKRVSEILKSGTPSNVPKTPSDKPKSEVVNTTTEPKKAETGAIGKATDTKIAKEEGDLSFNGAILKKAVLDKILANCKKHDILPSYAITVLHFEGLWGTSAVGKADNNWGGMTWTGKGERPSGVTVTQGTARPSVEGGYYMHYASVDDFLTDWFYLLRAGGSYKVSGAKTFSDAVKGMFKTGGAVYDYAATGYDNYLVGMSSRLKAIEAENGSLTKYDTATVTDISKTDKIEVNIEGIEISINGVTYTLSKKPV

SEQ ID NO: 1176 - protein, 470 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYARNGITVDNYNQTAAASGWMYCYVYRLANQSTPSTSGKTLDTLVKETLAGKYGNGDQRKAALGNQYEAIMAVINGKATASQKSIDELAQEVIAGKHGNGEARKKSLGSQYDAVQKRVTELLKKQPSEPSKAQEVKQPTETRTSQTEPAEKATVSKEDGDLSFNGTILKKAVLDKILANCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIEAENGSLSKYDTAIVTDINQSDDIEINVEGIEVIINGETYKLEKKPV

SEQ ID NO: 1177 - protein, 484 aa, Streptococcus pyogenes
MGINIEAAIAWMLARAGKVTYSMDYRNGPNSYDCSSSVYFALMSAGAISAGWAVNTEYEHDWLIKNGYTLVAEDQDWDSKRGDIFIWGQRGQSSGAGGHTGIFIDPDNIIHCNYAHNGITVNNYNQTAAASGWMYCYVYRLTNQASTPSTSPLGKDLDTLVRETLAGKYGNGDTRKAALGNQYEAVMAVINGKATAPKKTIDQLAQEVIQGKHGNGEERKKALSSDYDAVQKRVTEILKGSTSGNASKTPSDAPKSEVVNSSTEPKTGETRATGKATDTKITKEDGDLSFNGAILKKSVLDVILAKCKEHNILPSYAITVLHFEGLWGTSAVGKADNNWGGMTWTGKGERPSGVTVTQGSARPASEGENYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1178 - protein, 484 aa, Streptococcus pyogenes
MRINIEAAIAWMSARAGKVTYSMDYRNGPNSYDCSSSVYFALMSAGAISAGWAVNTEYEHDWLIKNGYTLVAEDQDWDSKRGDIFIWGQRGQSSGAGGHTGIFIDPDNIIHCNYAHNGITVNNYNQTAAASGWMYCYVYRLTNQASTPSTSPLGKDLDTLVRETLAGKYGNGDTRKAALGNQYEAVMAVINGKATAPKKTIDQLAQEVIQGKHGNGEERKKALSSDYDAVQKRVTEILKGSTSGNASKTPSDAPKSEVVNSSTEPKTGETEATGKATDTKITKEDGDLSFNGAILKKSVLDVILAKCKEHNILPSYAITVLHFEGLWGTSAVGKADNNWGGMTWTGKGERPSGVTVTQGSARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1179 - protein, 484 aa, Streptococcus pyogenes
MGINIEAAIAWMAAREGKVTYSMDYRNGPNSYDCSSSVYFALMSAGAISAGWAVNTEYEHDWLIKNGYTLVAEDQDWDSKRGDIFIWGQRGQSSGAGGHTGIFIDPDNIIHCNYAHNGITVNNYNQTAAASGWMYCYVYRLTNQASTPSTSPLGKDLDTLVRETLAGKYGNGDTRKAALGNQYEAVMAVINGKATAPKKTIDQLAQEVIQGKHGNGEERKKALSSDYDAVQKRVTEILKGSTSGNASKTPSDAPKSEVVNSSTEPKTGETGATGKATDTKITKEDGDLSFNGAILKKSVLDVILAKCKEHNILPSYAITVLHFEGLWGTSAVGKADNNWGGMTWTGKGERPSGVTVTQGSARPASEGENYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1180 - protein, 47 aa, Streptococcus pyogenes
MTNREIMIGELAREVIRGTFGNGNERKQRLGTLYHEVQDKVNEILWR

SEQ ID NO: 1181 - protein, 351 aa, unidentified
  REGION 1..351: note = Candidatus Aphodovivens avistercoris
MAKFIIDVSEHQGSIDWEAVKPHIDGAIIRCGYGNDDASQDDKQWARNVSECERLGIPFGVYLYSYATDPGMARSEAQHALRLIAGRKLQYPVYFDSEQPGTEGVARACAEAFGDVIEAAGYWCGVYASRSWFQSYINLDRFTKWIASWGSSDAGMGCDMWQYSSDGSIAGISGRVDCNWCYRDFPAEIGGGSPQAPAGGGKSVEQLAQEVIQGLHGNGDERKASLGSMYDAVQARVNELLGVSGGSSPSGTTYVVQSGDTLSGIGARFGVDYGAIASANGIADPDLIYAGQVLTIPDGSGSASGSSTYIVQAGDCLSVIGDKLGIDWTAIAANNGIGAPYTIYPGQVLYV

SEQ ID NO: 1182 - protein, 382 aa, Clostridium symbiosum
MKQFPLWKMRVLWVYHSRQSSPRLLIFYRKRQKVRVNNMMKGMDISKWQGAVDFAKVAASGIQFAILREGYRQAVDGKFFEYVNGCRANNIPVKGVYHFSYALNADQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYNAVQNKVNELCGTPKKSIDEIAMAVIRGEYGNGADRKNRITAEGYDYAAVQARVNALM

SEQ ID NO: 1183 - protein, 396 aa, Bifidobacterium adolescentis
MAITMAVAPAAMADLNGVDISGYQSSDIPSAISADFIIVKATQGLYWSNNNYATQLANADRTGKETSVYHFANGGNATAEADTFVNAVSGRVGRSILALDWEQCLAYGRYGCATVNPNWGNPAWIQTWVTRVHDRTQVWPIVYVQRSAVWQVNTWVRQRCMLWVAQYANTAPTGYQSSPWNGGVSGEGMTQYSSTGYIDGRGPLDLNRFYGDRTAWKKIACGERRGCSTGTVTPAPQVNKPAEQTPTDLNVLADKVIHGDYGNGQERINRLGGNYNAVMAIVNSKLGGSSSAQTTARTTTRTYVVRSGDTVSAIAERTGLKPASAWRVPSGNINRIYVGQVITYYGTTTTAASGYSTHVVRAGESLWSIYGSGWASAAARNGLRSPYVIYPGQRLR

SEQ ID NO: 1184 - protein, 484 aa, unidentified
  REGION 1..484: note = Aerococcaceae bacterium DSM 111020
MDLTYQNVTLPAEIVEHLIKEAERLSVPPSYLITKLHFEGVWGKSNVARQDNNWSGMTWTGDPKRPSGVVVGKGSARPANEGGHYMRYKNVDDFFKDWLHLIRRGGIYKVADSATFDKAVQGMFRYGGAKYDYATMNLPESQSKQRYEAYLRGMKARREAINQSNDGALDKLDKGVDYVAVTATQMLAEARKWIGSNKYGSNHKKIVDGYNQIRPLPMGYKVTYNDDWCDTFVSFVSKQVGALGLTGAECGVERHKNIFKQKGIWLGIKRPKAGDIIIFQWNGQRNGWAHHIGFVESVSGDYVTTIEGNTVKGGVSTVGRNTFKWDDWRIQGYARPKYGTSTGKSNKDKTVKELAEEVMAGLHGNGNDRKASLGSRYQEVQNHINGQTEPVDIDQLAKDVINNKYGNGDERKQALGKDYEAVQKRVNELLAEDTLDEVQETKEEAIKVVDKMALTSEQKNEIAQKILDLVSIDDIKKVLDEVLK

SEQ ID NO: 1185 - protein, 402 aa, Bifidobacterium ruminantium
MAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYGCATANPNWGNPAWIQTWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERVGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSTTAAPSTTYYGSTHVVSAGESLWKIYGSGWYAAAQRNGLRPPYTIYPGQRLR

SEQ ID NO: 1186 - protein, 471 aa, Treponema sp.
MRELKGIDISEWNGGLNYTELAKNIDFAILREGCRTRKDYLFDTHINGCRAARIPIRGVYHFIYAVNNNQAKIEAESCIKNVQAAGLPKSTWIWADLEYDTITKAKAQGVVLGPAEVRLFTETFCKTIKDAGYPVGIYTNLDYWVRMYGDDILSRYPVWYAQYSSKKAKDCLIWQCGSRVLPGSNGQALDYDIWYEQEDVVAEPVAYELNKSTEELAKEVIAGKWGSGEARKVALGARYDEVQKKVNEMLAPVTVPTQPPNIEQLAVDVIAGKYGTGDYRKKALGENYDAVQKRVNELLKAKTEVVAPALSDRRLAYVRQMQAWVGRNEADGSFRSIIDTYNKGLAKAVKTWGTRNVRMEYSWPWCACTVSAAAIACGLDDVVPIEISCPYMIEIAKKFGIWVEQDSYRPNPGDIIMYDWQDTGYGDNTGVADHVGVVESVEGNRFVVIEGNRNDSVSRRTMDINGLYIRG

SEQ ID NO: 1187 - protein, 467 aa, Blautia sp.
MKQLKGIDISEWNTGLDYTTLSKHIDFVILREGCRQRVDNMFTTHLAAFRALKTPIVGVYHFIYALNNQQARQEAESCIRNVEKAGLPKSTVIWADLEYDTITKAAQQGVSLGALEVRLFTETFCNTVQAAGYPTGIYTNLDYWLRMYGDEILSRYPVWYAQYSKTRAKNCTIWQYGSEKLPGSPAPLDVDIWYKTDEDVSGKTIDELAHEVLAGKWGNNPERQAALAGRYEEVQKRVNEILKGQTAPAYDVDALAKDVIAGRYGNGEDRIKALGDKYEAVQKRVNELLKAKVSEPVPALSDARTRYIRQMQSWVGRKEADGSFRPIIDTYNSGLAAAVKRWGTRNVRMQYDWAWCACTVAAAAMAAGVDDVVPIEISCPYMIEEAKRAGIWVENDAYVPTPGDIIMYDWQDSGVGDNQGQADHVGMVETVSGNQMTIIEGNRNDSVSRRTIQVNSMYIRGYIVPNF

SEQ ID NO: 1188 - protein, 41 aa, unidentified
  REGION 1..41: note = Atopobiaceae bacterium
MDVDAMARAVILGDHGNGEERRRQLGSYHSVVQACVNEMLS

SEQ ID NO: 1189 - protein, 382 aa, Roseburia inulinivorans
MKQFPLWKMRVLWGYHSHQLSPRLLIFYRKRQKVRANNMMKGMDISKWQGAVDFAKVAASGIQFVILREGYRQAVDGKFFEYVNGCRANNIPVKGVYHFSYALNADQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNALM

SEQ ID NO: 1190 - protein, 481 aa, Streptococcus agalactiae
MTVNIETAIAWMSARAGKVTYSMDYRNGPGSYDCSSSVYYALMSAGAISAGWAVNTEYEHDWLIKNGYKLIAENQDWDAKRGDVFIWGKRGQSSGAGGHTGIFIDPDNIIHCNYAHNGITINNYNQTAAASGWMYCYVYRLANQPSNSTTGKSLDTLVKETLAGVYGNGDTRKAALGNQYEAVMAVINGKATAPKKTIDQLAQEVIQGKHGNGEERKKSLGSQYEAVQKRVTEILKSSPSGNAPKTPSGTLKSEVENSSTEPKTEETGATGKVTELKIAKEVGDLSFNGAILKKSVLDVILAKCKEHNILPSYAITVLHFEGLWGTSAVGKADNNWGGMTWTGKGERPSGVTVTQGTARPTNEGGHYMHYSSVDDFLTDWFYLLRADGSYKVSGAKTFSEAVKGMFKVGGAVYDYAASGYDNYIVGMSSRLKAIEAENGSLSKFDVGTVDNVGSTDKIEVNIEGIEISINGIIYTISKKPV

SEQ ID NO: 1191 - protein, 342 aa, Streptococcus agalactiae
MTVNIETAIAWMSARAGKVTYSMDYRNGPGSYDCSSSVYYALMSAGAISAGWAVNTEYEHDWLIKNGYKLIAENQDWDAKRGDVFIWGKRGQSSGAGGHTGIFIDPDNIIHCNYAHNGITINNYNQTAAASGWMYCYVYRLANQPSNSTTGKSLDTLVKETLAAVYGTGDTRKAALGNQYEAVMAVINGKATAPKKTIDQLAQEVIQGKHGNGEERKKSLGSQYEAVQKRVTEILKSSPSGNAPKTPSCTLKSEVENSSTEPKTEETGATGKVTELKIAKEVGDLSFNGAILKKSVLDVILAKCKEHNILPSYAITVLHFEGLWGTSAVGKADNNWGGMTWT

SEQ ID NO: 1192 - protein, 276 aa, unidentified
  REGION 1..276: note = Clostridiales bacterium
MGKLWYLSPSDQTGNTGINGYGTEEAQMNALLDAITPHLARCGVRYHRASRDLGIDYRPAESDALGADYYLALHSNAGGGGAAYGPVAFYYAAGKELAEELIWQLQKTGQKSNRYQSVVQNRNLIETRSMKAASCLLEVDFHDSAEGVDFIVKRRSDASKAIAKAICAIDGTTWVDEDPFQEKMRTHLVKLGETLSAIAREYGTNYRHLADLNGIPDPNLIHVGQVLKIDGEKSLDDLALEVYRGEWGNGQERKDRLTEAGYDYDAVQDRVNTLYG

SEQ ID NO: 1193 - protein, 247 aa, Clostridium sp.
MSLRNRVLESKELEITQNYKKGYHDGIDVVNKNYTLGNIVAHSNGIVISYRNDCNGFENGSYGNYVKIKHNNGYYTLYAHMAYNSVKVKEGQNVTKGQVLGYMGNTGMSYGGHLHFEVRNTSDIRIDPTSYLNSDLPNINKTIEELVKEVIEGKWGNGEERKRRLGDKYIEVQTRVNEKLQSKTKYLYNPNYKGNSIVDGLKEISIDSSYNYRKKLAKINNINNYIGSAEQNTTLLNLLKKGKLIDA

SEQ ID NO: 1194 - protein, 292 aa, unidentified
  REGION 1..292: note = Oscillospiraceae bacterium
MSTAMKYVPRLSAPSKADKHWIKSTKGGLNICIEIENGSVLPNCVGYAWGRFYEIIGAKPKLASLNAEDWYGNASDGYKRSQAPKLGAVACWRKGKVWNGADGYGHVAIVEKIKPNGDIVCSNSAYGGSRFYMQTYLKSNGYNSGSLTFQGFILPPVDFPAQYETPPETSSISSSSSSTAAFKIGDIVDFTGSTHYVSSTGTKGTAAKPGRAKITIIAPSTAHPYHVIAECGGGSTVYGWVNKSDIVHKKSVGDLAKEVIHGDWGNGDERKRRLTAAGYDYYAVQKRVNELL

SEQ ID NO: 1195 - protein, 204 aa, unidentified; identical to SEQ ID NO: 151
  REGION 1..204: note = Muribaculaceae bacterium

SEQ ID NO: 1196 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAKRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATALKKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1197 - protein, 247 aa, unidentified
  REGION 1..247: note = Bacilli bacterium
MSLRNRVLESKELEITQNYKKGYHDGIDVVNKNYTLGNIVAHSNGMVISYRNDCNGFENGSYGNYVKIKHNNGYYTLYAHMAYNSVKVKEGQNVTKGQVLGYMGNTGMSYGGHLHFEVRNTSDIRIDPTSYLNSDLPNINKTIEELVKEVIEGKWGNGEERKRRLGDKYIEVQTRVNEKLQSKTKYLYNPNYKGNSIVDGLKEISIDSSYNYRKKLAKINNINNYIGSAEQNTTLLNLLKKGKLIDA

SEQ ID NO: 1198 - protein, 406 aa, unidentified
  REGION 1..406: note = Streptococcus phage Javan150
MTVDTEKAIAWMGLKEGRVSYSMDYRNGPDSYDCSSAICSALIYAGASNPGWLLNTEYMHDWLVQNGYELIAENVGWDSQRADIAIWGMRGQSAGAGGHVVMFIDADNIIHCNYANNNITIDNYNQTAAASGWMYSYAYRYTGATDTDVATKSIDELAQDVLAGKYGSGEQRKISLGSNYDAVQAKVNEMLKQPQVAEQSPAVKQDGDLLFNGAVLKKAVLDKILVKCKEHDILPSYAITVLHFEGLWGQSAVGRTDNNWGGMTWTGQGNRPSGIIVTKGTDRPLNEGGHYMHYESVDDFLTDWFYLLRAGGSYKVSGAKTFSEAVKGMFKAGGATYDYAASGFDSYIVGASSRLKAIEAENGSLAKFDAVSNIVSSTDPDKIEVTIEGIEVSINGVTYQLTKKPV

SEQ ID NO: 1199 - protein, 372 aa, unidentified
  REGION 1..372: note = Arthrobacter phage Ingrid
MTFSPLINGTIPNNGKYSSRHGKPILKFLQHHWAGTTGGVERMTGPDQASANYVILTDGKLLGHVPEEFRAWTSGSFDADGDAITVEVQNIHGRVNGNDNDPSSWAISDAAYVTLVKLIADVAKRHGWGAVSTGNYQGHRQWAPTACPGGWLWARMENTRVKANKVLTGGAAAPVPTTPPVKGKTVWQLADEVVAGLHGSGDARKVSLGTQYAAVQAEVNRRHGVGVAPAATKTVSQLADEVLAGKHGTGDARQKSLGNMYTAVQNEVNRRTGGGGKAPQGVNISQLADKVLRGEFGSGDARVRALGANYAAVQSEVNRRLGGGKAVVASPRLSISQLADAVLRGEFGNGDDRKKRLGANYAAVQAEINRRL

SEQ ID NO: 1200 - protein, 402 aa, Bifidobacterium adolescentis
MAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYGCATANPNWGNPAWIQTWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSHTYVVRYGDTVSAIAERTGLKPASAWRVPSGNINRIYVGQTITYYGSVSATAAPSTTYYGSTHVVSAGESLWKIYGSGWYAAAQRNGLRPPYTIYPGQRLR

SEQ ID NO: 1201 - protein, 402 aa, Bifidobacterium adolescentis
MAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYSCATANPNWGNPAWIQIWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSTTAAPSTTYYGSTHVVSAGESLWKIYGTGWYAAAQRNGIRPPYTIYPGQRLR

SEQ ID NO: 1202 - protein, 382 aa, unidentified
  REGION 1..382: note = Clostridium sp. OF03-18AA
MKQFPLWKMRVLWGYHSRQLSPRLLIFYRKRQKVRANNMMKGMDISKWQGAVDFAKVAASGIQFVILREGYRQAVDGKFFEYVNGCRANNIPVKGVYHFSYALNADQARNEASFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNALM

SEQ ID NO: 1203 - protein, 382 aa, unidentified
  REGION 1..382: note = Clostridium sp. TM06-18
MKQFPLWKMRVLWVYHSRQSSPRLLIFYRKRQKVRANNMMKGMDISKWQGAVDFAKVAASGIQFAILREGYRQAVDGKFFEYVNGCRANNIPVKGVYHFSYALNTDQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGTDRKNRITAEGYDYAAVQARVNALM

SEQ ID NO: 1204 - protein, 344 aa, unidentified
  REGION 1..344: note = Bacteriophage sp.
MMKGMDISKWQGAVDFAKVAASGIQFAILREGYRQAVDGKFFEYVNGCRANNIPVKGVYHFSYALNTDQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGEYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGTDRKNRITAEGYDYAAVQARVNTLM

SEQ ID NO: 1205 - protein, 484 aa, unidentified
  REGION 1..484: note = Bacteriophage sp.
MGINIEAAIAWMLARAGKVTYSMDYRNGPNSYDCSSSVYFALMSAGAISAGWAVNTEYEHDWLIKNGYTLIAENQDWDAKRGDVFIWGRRGQSSGAGGHTGIFIDPDNIIHCNYAHNGITLNNYNQTAAASGWMYCYVYRLTNQASTPSTSPAGKDLDTLVRETLTGKYGNGDTRKAALGNQYEAVMAVINGKATAPKKTIDQFAQEVIQGKHGNGEERKKALGSDYDAVQKRVTEILKGSTSGNAPKTPSDAPKSEVVNSSTEPKTGETGATGKATDTKITKEDGDLSFNGAILKKSVLDVILAKCKEHNILPSYAITVLHFEGLWGTSAVGKADNNWGGMTWTGKGERPSGVTVTQGSARPASEGGNYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1206 - protein, 344 aa, unidentified
  REGION 1..344: note = Bacteriophage sp.
MMKGMDISKWQGAVDFAKVAASGIQFVILREGYRQAVDGKFFEYVNGCRANNIPVKGVYHFSYALNADQARNEAAFCITQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSIDEIAQEVINGAWGNGQDRKNRIEQAGYDYTAVQNKVNELCGTPKKSIDEIARAVIRGEYGNGADRKNRITAEGYDYAAVQARVNALM

SEQ ID NO: 1207 - protein, 344 aa, unidentified
  REGION 1..344: note = Bacteriophage sp.
MMKGMDISKRQGAVDFAKVAASGIQFVILREGYRQAVDGKFFEYVNGCRANNIPVKGVYHFSYALNTDQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNALM

SEQ ID NO: 1208 - protein, 361 aa, unidentified
  REGION 1..361: note = Arthrobacter phage Inked
MALPITHINEQFNAVFFTAGPTEKDGIVIHWWGLPQGQGIDSVRSTFGGGGRQASAHYGATDGQVDCYVSPDDIAWANGNWAANLSKISIECNPRQSDGDYYAAAWTIAYVRSIYGDLPLSRHWDYYPTQCCGTYDLDRLDREARQIAAQGLWNNVPLPTPGTPVVPAPPAPATGAKSIDQLAQEVIAGAYGTGDARRVALGGQFDAVQARVNEILLGTSNPKPQPSISELADRVLRGEFGNGDQRITALGNQYQAVQNEINRRAGISAPVSVPSAPNIDDLVRRTLAGEFGNGDDRIRALGTNYQAVQDRINGGSGGGGVNINDLVERTLRGEFGNGDDRIRNLGGNFQAVQNEINRRYS

SEQ ID NO: 1209 - protein, 422 aa, Bifidobacterium ruminantium
MRKHKPPWLKRFRLAVTGVVMAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYGCATANPNWGNSAWIQTWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSATAAPSTTYYGSTHVVSAGESLWKIYGSGWYAAAQRNGLRPPYTIYPGQRLR

SEQ ID NO: 1210 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAKRHDVFIWGKRGYSSGEGGHTGIFVDNVNIIHCNFKRNGITIDDYNKVSRGMYYYLYRPANQPSISNKSLEQLVKETLAGVHGNGDARKASLGNQYEPVMAVINGKATALKKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1211 - protein, 470 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNGITVDNYNQTAAASGWMYCYVYRLANQSTPSTSGKTLDTLVKETLAGKYGNGDQRKAALGNQYEAIMAVINGKATASQKSIDELAQEVIAGKHGNGEARKKSLGSQYDAVQKRVTELLKKQPSEPSKAQEVKQPTETRTSQTEPAEKATVSKEDGDLSFNGTILKKAVLDKILANCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIEAENGSLSKYDTAIVTDINQSDDIEINVEGIEVIINGETYKLEKKPV

SEQ ID NO: 1212 - protein, 453 aa, unidentified
  REGION 1..453: note = Streptococcus cuniculi
MAINTDTAISWFEARKGKVSYSMDYRDGPNSYDCSSSVYYALMSAGAISAGWAVNTEYEHDWLIKNGYKLVAENQDWNSQRGDIFIWGKRGQSSGAGGHTGIFIDADNIIHCNWGKRGISVDNYDTVAAASGWMHCYVYRLGGSSTNSTSGKSLDTLVQETLAGKYGNGDVRKAALGNQYEAVMAIINGKTATPKKTIEQLAQEVIQGKHGNGEDRKKSLGSDYDAVQRRVTEILQGSTPSPAPKQTKEAGDLSFNGAILKKAVLDKILNNCKKHNILPSYALTILHFEGLWGTSAVGRTDNNWGGMTMTSNDERIIRPSEITVIRGLARPSNEGGYYMHYASVDDFLTDWFYLLRAGGSYKVSGAKTFSEAVKGMFRVGGAKYDYAASGFDNYIVGASSRLKAIESENGSLTKYDLIPDSPNNLQPDKIDVTLDGVEVSINGVKYTLNKKPV

SEQ ID NO: 1213 - protein, 470 aa, unidentified
  REGION 1..470: note = Streptococcus varani
MAVNIEVSIAWMTSRAGKVTYSMDYRNGPGSYDCSSSVYYALMSAGAITAGWAVNTEYQHDWLIKNGYKLIAENKDWDAKRGDVFIWGRRGQSSGAGGHTGIFVDPDNIIHCNYARNGITIDNYNQTAAASGWMYCYVYRLSNQSSTSTAGKSLDTLVKETLAGVYGNGDTRKAALGNQYEAVMAVINGKATANQKTVDQLAQEVIAGKYGNGEARKKSLGSQYDAVQKRVTELLKKQPSEPSKAQEVKQAHGTKTIQTEPTGQATATKEEGDLSFNGAILKKAVLDKILANCKKHNILPSYAITCLHFEGLWGTSAVGKADNNWGGMTWTGQGQRPSGVTVTQGSARPSNEGGHYMHYASVNDFLTDWFYLLRAGGSYKVSGAKTFSEAVKGMFKVGGAVYDYAASGYDNYIVGMSSRLKAIEAENGSLAKFDVATVDNVGSTDKIEVNIEGIEISINGVTYTISKKPV

SEQ ID NO: 1214 - protein, 323 aa, Bifidobacterium choerinum
MSTYEYITKYDAACYTPGRPYGITAITIHWWDDPAVRRPNFDTVINLFVSGARKTSAHYVAEAGRVACLVAPGDRAWACGDGINVGSGGNDKSISIECNWRQSDGDYDTIAQLVADLRTTYGDLPLKPHRTWTSTECPGTYDLARIDRLARQKAGQKVPTAAPANPAPQPSGKLTVDRVAREVINGKWGNGADRMARLKAAGYDAAAVQAKVNEICGISGAAGPAPAAGIDAIARDVIAGAYGNDPQRSQTLRAMGYDPAAVQARVNQMLGAGSSASASKPAANIDDLARRTIAGEFGNGDARRSALGANYEAVQARVNQMLG

SEQ ID NO: 1215 - protein, 334 aa, Alloscardovia omnicolens
MKNWDTVEADVTKILDKHYTKGRDGANIRFIVVHHNAANLTVDGCYSVWQSRPASAHYQVQSDGTIGQLVWDADTAWHAGGWNANIQSIGIEHADDNNNPWHISEATLDNGAHLVAALCKFYKLGRPQWGVNVFPHSHFSATACPASIASDQNNAYMQRAQAYYGQMNGGAPAVPPAPAPTSNERNNRKDNDTIANEVLAGAWGNGSDRATRLAQAGYDYNVIQSLVNQKLGQGTGTAQPTASIDDIARKVINGEYGNGTDRATRLEQAGYDYAVVQAKVNELLGQANTGQQDLTEVARAVIRGDYGNGDTRRARLQAAGYDYQAVQARVNQLL

SEQ ID NO: 1216 - protein, 47 aa, unidentified
  REGION 1..47: note = Streptococcus
MTNREIMIGELAQEVIRGTFGNGNERKQRLGTLYHEVQDKVNEILWR

SEQ ID NO: 1217 - protein, 242 aa, Olsenella uli
MAGSVSKLVERMRWWCDEANLGYCQANRQDMRVGGEADCSSLVIHCLKEAGFDVGSAMYTGNLRANLVARGWVVCKVDGSPRVGDILLNDGRHVAVCTAAGMVSEASINEKGTANGGAPGDQTGLETRTRKYNSYPWSCYLRYAAAQTGGPSGTADELARRVIAGEFGSGNARRGALGSRYAEVQARVNEILHGGVSGGTQPSMDELARAVIAGRYGVGEARRKALGSRYAEVQRRVNQLLS

SEQ ID NO: 1218 - protein, 481 aa, Streptococcus canis
MTINIETAIAWMAARAGKVTYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYEAVMAVINGKATTTQKSIDELAKEVIAGKHGNGEDRKKALGSQYDAVQKRVTEMLKTSTSGNASNTPSEPSKSEVVNSVTEPQKTETGQAGKATDSKITKEDGDLSFNGAILKKSVLDIILAKCKEHDILPSYAITVLHFEGLWGTSAVGKADNNWGGMTWTGKGERPSGVTVTQGTARPSSEGGYYMHYSTVDDFLTDWFYLLRAGGSYKVSGAKTFSEAVKGMFKVGGSTYDYAATGYDNYLVGMASRLKAIEAVNGSIAKFDVGTVGNVGSTDKIEVNIEGIEISINGVTYTISKKPV

SEQ ID NO: 1219 - protein, 405 aa, Streptococcus dysgalactiae
MTVDTEKAIAWMGLKEGRVSYSMDYRNGPDSYDCSSAICSALIYAGASNPGWLLNTEYMHDWLVQNGYELIAENVGWDSQRADIAIWGMRGQSAGAGGHVVMFIDADNIIHCNYANNNITIDNYNQTAAASGWMYSYAYRYTGATDTDVATKSIDELAQDVLAGKYGSGEQRKISLGSNYDAVQAKVNEMLKQPQVAEQSPAVKQDGDLLFNGAVLKKAVLDKILVKCKEHDILPSYAITVLHFEGLWGQSAVGRTDNNWGGMTWTGQGNRPSGITVTQGTERPAVECGHYMHYASVDDFLTDWFYLLRADGSYRVSGAKTFSEAVKGMFKVGGATYDYAASGYDNYLVGMASRLKAIEQENGSLAKYDQLTDIDVGQSDKIDVVIDSLEISINGVTYTATKKPI

SEQ ID NO: 1220 - protein, 382 aa, Streptococcus suis
YSSGEGGHTGIFVDNVNIIHCNFKRNGITIDDYNKVSRGMYYYLYRPANQPSISNKSLEQLVKETLAGVHGNGDARKASLGNQYEPVMAVINGKATALKKTIDELVQEVIAGKHGNGEERKKSLGSDYDAVQKRVTEILKSDTSGNTPKTPSDTPKSGAVNSSTEPKIEETEPTGNATVNKEEGDLSFNGAILKKAVLDKILANCKKHDILPSYALTILHYEGLWGTSAVGKADNNWGGMTWTGQGNRPSGVTVTQGTDRPSNEGGHYMHYANVDDFLTDWFYLLRVGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1221 - protein, 344 aa, unidentified
  REGION 1..344: note = Clostridium sp. TM06-18
MMKGMDISKWQGAVDFAKVAASGIQFAILREGYRQAVDGKFFEYVNGCRANNIPVKGVYHFSYALNTDQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGTDRKNRITAEGYDYAAVQARVNALM

SEQ ID NO: 1222 - protein, 344 aa, Clostridium symbiosum
MMKGMDISKWQGAVDFAKVAASGIQFAILREGYRQAVDGKFFEYVNGCRANNIPVKGVYHFSYALNADQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYNAVQNKVNELCGTPKKSIDEIAMAVIRGEYGNGADRKNRITAEGYDYAAVQARVNALM

SEQ ID NO: 1223 - protein, 351 aa, unidentified
  REGION 1..351: note = Bacillus sp. J14TS2
MATKNGVPFRQMLVATSKHGIKCPNTMVPKKITIHNTDNQMPAVNEISYMRGNNNEVSFHVAIDEKEAVQGLPFNRNGWHAGDGGNGYGNRNTVGIEMCRNYDRNRNTTNLNDPLSSQFKKTFDNTVKVVAQLCVDLGIVASKSNIKQHKDWSGKHCPSKILNDKTWDQLVNGIIGEYNRLKGKPASKPQPAPSKPKTKSIEQLVDEVIAGKHGSGAERKKSLGNQYDAVQKRVNEKLLGTKSKPKPAEKSIDTLVKETLAGKHGNGEARKKSLGKNYQAVQDVINGNTSTPKKPSKPKGDQKTNSIVDYLKSIKADSSFANRKKLATKHGIKNYSGTPAQNTQLLKKLRG

SEQ ID NO: 1224 - protein, 344 aa, Roseburia inulinivorans
MMKGMDISKWQGAVDFAKVAASGIQFVILREGYRQAVDGKFFEYVNGCRANNIPVKGVYHFSYALNADQARNEAAFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNALM

SEQ ID NO: 1225 - protein, 481 aa, Streptococcus equi
MTVNIETAIAWMSARAGKVTYSMDYRNGPGSYDCSSSVYYALMSAGAISAGWAINTEYEHDWLIKNGYKLIAENQDWDAKRGDVFIWGKRGQSSGAGGHTGIFIDPDNIIHCNYANNGITINNYNQTAAASGWMYCYVYRLANQPSNSTTGKSLDTLVKETLAGVYGNGDTRKAALGNQYEAVMAVINGKTTVPKKTIDQLAQEVIQGKHGNGEERKKSLGSQYEAVQKRVTEILKSSPSGNAPKTPSGTLKSEVVNSSTEPKTEETGATGKVTELKIAKEVGDLSFNGAILKKSVLDVILAKCKEHNILPSYAITVLHFEGLWGTSAVGKADNNWGGMTWTGKGERPSGVTVTQGTARPTNEGGHYMHYSSVDDFLTDWFYLLRADGSYKVSGAKTFSEAVKGMFKVGGAVYDYAASGYDNYIVGMSSRLKAIEAENGSLSKFDVGTVDNVGSTDKIEVNIEGIEISINGIIYTISKKPV

SEQ ID NO: 1226 - protein, 59 aa, unidentified
  REGION 1..59: note = Schaalia sp. ZJ405
MNCQATPAPAPNPEPAAKSIDGLSYEVIKGKWGNGDERRRRLGNLYGQVHARVNAKLDY

SEQ ID NO: 1227 - protein, 422 aa, Bifidobacterium ruminantium
MRKHKPPWLKRFRLAVTGVVMAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYGCATANPNWGNPAWIQTWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERVGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSTTAAPSTTYYGSTHVVSAGESLWKIYGSGWYAAAQRNGLRPPYTIYPGQRLR

SEQ ID NO: 1228 - protein, 358 aa, unidentified
  REGION 1..358: note = Bacillus sp. SD088
MVKVALDAGHGGFGVTPGKRTPAGEYEWNFNDKVVVAAIKYLKQYKGVEVLRLDDPTGKTDVSLTARTNKANNWGADILISCHHNANTGNWGSWTGTEVYTYDKNLPNAEKLASIVLKHILKAYGLANRGHRRADFHMLRESKMDAILIEGGFMDSTIDIKKLRNNKVLDAAGKAVAEGVTEYFGLKKATTKPVETEVDGVSTEKPNSKTIDQLANEVIAGKHGSGAQRKKSLGSQYDAVQKRVNEKMGAKPKPAAKSIDTLVKETLAGKHGNGEARKKSLGKNYQAVQDAINGNTSTPKKPSKSKGDQKTNSIVDYLKSIKVDSSFANRKKLAAKHGIKNYSGTAGQNAQLLKKMRG

SEQ ID NO: 1229 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDSDNIIHCNYARNGITVDNYNQTAAANGWMYCYVYRLANQTSTSGKSLETLVQETLAGKYGNGDTRKAALGNQYEAVMAVINGKATASQKSIDELAQEVIRGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGNRPSGVTVTQGSARPSNEGGHYMHYASVDDFLTDWFYLLRASGSYKVSGAKTFSEAVKGMFKVGGAVYDYAASGFDSYIVGASSRLKAIEAENGSLDKFDKLTVTDVGQSDKIEVTIEGIEISINGVTYELTKKPV

SEQ ID NO: 1230 - protein, 422 aa, Bifidobacterium adolescentis
MRKHKPPWLKRFRLAVTGVVMAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYGCATANPNWGNPAWIQTWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSHTYVVRYGDTVSAIAERTGLKPASAWRVPSGNINRIYVGQTITYYGSVSATAAPSTTYYGSTHVVSAGESLWKIYGSGWYAAAQRNGLRPPYTIYPGQRLR

SEQ ID NO: 1231 - protein, 422 aa, Bifidobacterium adolescentis
MRKHKPPWLKRFRLAVTGVVMAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYSCATANPNWGNPAWIQIWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSTTAAPSTTYYGSTHVVSAGESLWKIYGTGWYAAAQRNGIRPPYTIYPGQRLR

SEQ ID NO: 1232 - protein, 274 aa, Bifidobacterium adolescentis
MTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSTTAAPSTTYYGSTHVVSAGESLWKIYGTGWYAAAQRNGIRPPYTIYPGQRLR

SEQ ID NO: 1233 - protein, 422 aa, Bifidobacterium pseudocatenulatum
MRKHKPPWFKRFRLAVTGVVMAITMAVAPAAMADLNGVDISGYQSADIPSAISADFVIVKATQGLYWSNNNYATQLANADRTGKETGVYHFANGGNATAEADTFVNAVAGRVGRSILALDWEQCLAYGRYGCATANPNWGNPAWIQIWVTRVHDRTQVWPIVYVQRSAVWQVNTWVRQRCMLWVAQYANSQPTGYQPSPWNGGASGEGMTQYASTGYINGRGPLDLNRFYGDRTAWKKIACGERAGCSTGTVTTAPQVNKPAEQTPTDLNVLADKVIHGDYGNGQERINRLGGNYNAVMAIVNSKLGGGSSTQTTVTRTPSRTYVVRSGDTVSAIAERTGLKPASAWRVPSGNINRIYVGQTITYYGSVSATAAPSTTYYGSTHVVSAGESLWKIYGSGWYAAAQRNGLRPPYTIYPGQRLR

SEQ ID NO: 1234 - protein, 249 aa, unidentified
  REGION 1..249: note = Varibaculum timonense
MSYTYETQYNSPNYQKGRPAGAPAFIVIHHWGIDGQKHHNVVSYLCRKGGNSSAHYVASAGIVTCIVDPDDRAWHAGKTGNPRGIGIECRPECSDGDFRTVAELIAELRKTYGNLPLVGHKDHMNTDCPGRWYPRLQELSNLANSLKGGTSTPAPAPSLDLEALATAVIAGKYGNGEARKRALGANYQAVQAIVNKRLTGKSKPAPSVNLEALATAVIAGKYGNGEARKRALGANYQAVQAIVNKRLKG

SEQ ID NO: 1235 - protein, 410 aa, Bifidobacterium adolescentis
MRKHKPPWLKRFRLAVTGVVMAIAMVVAPAAMADLNGYDVSGYQAPDITQVAPADFAIVKVNQGWYINSSWGQQASGAVNTGKELGLYDYASGMDATTEADNFVNHITGYVGKAMLVLDWEPYQNAAWGNSNWVRTWVYRVHARTGVWPVVYCSKGFVGQIPADIRAKCMLWAAQYANNYATGYQDSPWLAGSQGEGMLQYTSTGYLNGRGPLDLDRFFGDRTAWRKIACGERAGCSTTGGSTGTPNVHVEKRTTNTTDLNALATAVIRGDYGNGADRQARLGDNYQAVMNIVNSRLSGSTYPGPTTVTRTYVVRSGDTVSAIAERTGLKPASAWRVPSGNINRIYVGQTITYYGSSATSTPSKTYYGSSTHVVSAGESLWKIYGAGWYAAARRNGIRPPYTIYPGQRLR

SEQ ID NO: 1236 - protein, 285 aa, unidentified
  REGION 1..285: note = Parvibacter caecicola
MQKVIDVSYHNGVIDWQRVKDAGYHAIIRCGYGSDFENQDDEQFKRNADECTRLGIPWGAYLYSYAKGATQAKSEAAHAIRLCEPYKDVMAYPLFFDTEESGTETISASNATIFCSNVKAAGFTAGIYASQAWWQENLGNVNGYVKWVARWSSAQPTTNGWQIWQYSEKGNVPGIKTRVDMNYSRYPVKETAPSKPQDVVSNVDQMAENTISGMYGNGESRKKALGKSYNVVQLIVNQKLTGKWTGLDTVAREVIAGEHGNGAARKKNLGSAYDAVQKRVNELLK

SEQ ID NO: 1237 - protein, 334 aa, Alloscardovia omnicolens
MKNWDTVEADVTKILDKHYTKGRDGANIRFIVLHHNAATLTIDGCYSVWQSRPASAHYQVQADGTIGQLVWDADTAWHAGGWNANIQSIGIEHADDNNNPWHISEATLDNGAHLVAALCKFYKLGRPQWGVNVFPHSHFSATACPASIASDQNNAYMQRAQAYYGQMNGGAPAVPPAPAPTSNERNNRKDNDTIANEVLAGAWGNGSDRATRLAQAGYDYNLIQSLVNQKLGQGAGTAQPTVSIDDIARKVINGEYGNGTDRATRLEQAGYDYAVVQAKVNELLGQANTGQQDLTEVARAVIRGDYGNGDTRRARLQAAGYDYQAVQARVNQLL

SEQ ID NO: 1238 - protein, 103 aa, unidentified
  REGION 1..103: note = Gleimia europaea
MRLRRSRKGYYTPRLPDIDITQYSTNALAEAVLRGELGDGIDRMRVLGHKYDSVQALVNEKIDGYARRVLNGEYGNGRERQKRLGYLYPAVQARVNEMVRGGW

SEQ ID NO: 1239 - protein, 405 aa, Streptococcus canis
MTVDTEKAIAWMGLKEGRVTYSMDYRNGPDSYDCSSAICSALIYAGASNPGWLLNTEYMHDWLVQNGYELIAENVGWDSQRADIAIWGMRGQSAGAGGHVVMFIDADNIIHCNYANNNITIDNYNQTAAASGWMYSYAYRYTGATDTDVATKSIDELAQDVLAGKYGSGEQRKISLGSNYDAVQAKVNEMLKQPQVAEQSPAVKQDGDLLFNGAVLKKAVLDKILVKCKEHDILPSYAITVLHFEGLWGTSAVGKADNNWGGMTWTGKGERPSGVVVTQGSARPSNEGGHYMHYATVDDFLTDWFYLLRQGGSYKVSGAKTFSEAVKGMFIVGGAKYDYAASGYDNYIVGMSSRLKAIEQENGPLNKYDQQTDISVGQSDKIDVVIDSLEITINGVTYTATKKLI

SEQ ID NO: 1240 - protein, 132 aa, unidentified
  REGION 1..132: note = Pseudogracilibacillus sp. SO30301A
MLIWLLHYKKTYPHLKYIKGHNEFKDRMERLAFVLIIRAVLANKSTSKPNTNTNTSKPKSKSIDQLADEVNVGKHSSGAQRKKALGSQYDAVQKRVNEKLLGTKPKAKPAEKSIDQLVKEILAGKHGNGEAR

SEQ ID NO: 1241 - protein, 254 aa, Trueperella pyogenes
MSNYAYLTGYTSPNYTPGRPHAPEEITIHHWGAEGQKFDAVVRWLCRPDGSSSSTYVAEGGRVACIVDPDNTPWTNSNFASNQKSITIECRPECTATDFATVVELVADIRRAYPTIKRIRGHRDHANTACPGKWYGRLFEIWDGASRILAHESTTPAPAPTPAPAAKSIAQLADEVLAGRHGNGADRRRSLGSQYDAVQAEVNRRLAPAAPAAKSIAQLADEVLAGRHGNGADRRRSLGDQYAAVQAEVNRRLA

SEQ ID NO: 1242 - protein, 238 aa, unidentified
  REGION 1..238: note = Clostridia bacterium
MFKLALNAGHGYETAGKRCLKSIDPKETREYELNRRICDKIAAILGGTDIKIIRIDNGKDIPIRSRAAMANTGDADLYLSIHHNAGIRGGAGGGIEAYVYPNVDAKTLNWQRILYNATVAATGLRGNRAQPLRSADFGELRLTKMPAVLLECGFMDSTTDTPIILGDDFAQKIANAVSEVIIVKSGVKRNDTAKKTNEQLADEVIRGLWGNGAERRKRIADAGYDYAAIQRLVNERLA

SEQ ID NO: 1243 - protein, 323 aa, unidentified
  REGION 1..323: note = Shouchella patagoniensis
MMPKLVQDFIPKSNGNRPGFAMTPEYITVHETGNRSAGANAEMHGRFIKNPSTAASWHITVDDGDVAIQHLPFNENGWHCGDGRDGTGNRKSIGIEICVNSDGDFEKAKQNAAFIIRDLMDRFNIPMSKVVQHWDWSRKNCPQNIRANEGFPAFKQRIPASVNAAPTKPAAKPAPKPSGKSIDQLADEVIAGKHGTGDARKKSLGSQFAAVQARVNEKLGAKPKPAAKTNAQLAQEVIDGKWGNNPQRNQRLNSAGHNASAVQAEVNRILGGGKSTASNRKSIDQLAREVINGKWGNNPQRSQRLKAAGYDANAVQRRVNQLL

SEQ ID NO: 1244 - protein, 344 aa, unidentified
  REGION 1..344: note = Clostridium sp. OF03-18AA
MMKGMDISKWQGAVDFAKVAASGIQFVILREGYRQAVDGKFFEYVNGCRANNIPVKGVYHFSYALNADQARNEASFCIAQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNALM

SEQ ID NO: 1245 - protein, 317 aa, unidentified
  REGION 1..317: note = Arthrobacter phage Tenno
MAPLPITGINEQYNAVYFTAGPTEKDGIVIHWWGLPQGQGIDSVRTTFGNGGRQASAHFGATDGQVDCYVNPDDVAWANGNWAANLSKISIECNPRQSDGDYYAAAWTIAYIRSIYGDLPLSRHWDYYPTQCCGTYDLNRLDQLAYDIAALGIWSNPPATPAAPVVPAPAAPATQTKSVDQLAQEVIAGAYGTGDARRAALGGQYAAVQARVNEILSGSSNPKPQPDINALVDAVLRGEYGNGDQRITALGNQYQAVQNEINRRAGISAPVTVPSAPNIEDLVRRTLAGEFGNGDDRVRALGANYTAVQAEINRRYA

SEQ ID NO: 1246 - protein, 281 aa, unidentified
  REGION 1..281: note = Caudoviricetes sp.
MNVRTTKPTSGNKFFITKSKGGYSTCIQGSPTDSQCNVLSNCVGYACGRFNEIIGAMKYPSLNCNAENFIERAKNTYGLEISSVPTLGGIMVWQKGTLSGNDGAGHVAVVEKIIDNNTIYTSESGYGGSAFWNSTRRNTNGRWGLGSAYTFRGCIVNPAIGKVVAPTPTPSAKKSVDEVAKEVIRGEWGNGDERYNRLTNAGYNYNEVQAKVNELLNSNKPTPAPTPSVDILDLVRKTIRGDFGNGEARRKALGSNYDEVQRQVNLNLKNGLTRWDNIKLF

SEQ ID NO: 1247 - protein, 281 aa, unidentified
  REGION 1..281: note = Caudoviricetes sp.
MNIRTTKPTSGNKFFITKSKGGYSTCIQGSPTDSQCNVLSNCVGYACGRFNEIIGAMKYPSLNCNAENFIERAKNTYGLEISSVPTLGGIMVWQKGTLSGNDGAGHVAVVEKIIDSNTIYTSESGYGGSAFWNSTRRNTNGRWGLGSAYTFRGCIVNPAIGKVVAPTPTPSAKKSVDEVAKEVIRGEWGNGDERYNRLTNAGYNYNEVQAKVNELLNSNKPTPAPTPSVDILDLVRKTIRGDFGNGEARRKALGSNYDEVQRQVNLNLKNGLTRWDNIKLF

SEQ ID NO: 1248 - protein, 371 aa, unidentified
  REGION 1..371: note = Caudoviricetes sp.
MNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVRHDPVRPQVTVTPDYNDMATKVIRGVYGNGNERRQALGGAYDTVMAIVNQRLGGSGGASTAVNCGSVCVTVRYGDTLSTIAASNGGSWNQWTGYRSGNPNVIYAGETVCRRTGTGTVATGGRYVVRSGDTLGGIAAYYGVNMYSIHGYRSGNPALIYPGETLYW

SEQ ID NO: 1249 - protein, 310 aa, unidentified
  REGION 1..310: note = Caudoviricetes sp.
MTLRGIDIASYQAGIDLSVVPCDFVIVKATEGVNYVNPDCDRAVQQAIRLGKCWGTYHYVNGSGAVAEADYYVNNIKGYLGKGILCIDWESGSNRAWGNYAYLDALVSRVIERTGIKPLIYVQASAYTQTAAVAQRHDCGLWIAQYADMNATAYQDTPWNEGAYSCAIRQYSSAGRLNGWNGNLDLDKFYGDANAWRKYAGASGAATPASKPVDPLAGKSDNQLADEVIAGKYGDGENRKRALGNRYNAVQAIVNQKLGGGHQSRTYTVRAGDTLSGIAARYGTTWQHLQQINGIRDANLIFAGQVLRID

SEQ ID NO: 1250 - protein, 489 aa, unidentified
  REGION 1..489: note = Caudoviricetes sp.
MASARKCATTSSTRTYRRTGIDAPHDRGRHLPAAARLVARLQSWRAQALIFTPVFKAIPLRDGFSICPLTWGREGEDVGILNNKGKPKHKRLRRHIGKPLTALAAVLCVAVAPVASANMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYANMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGCSGGAPAAVNCGSLCVTVRYGDTLSTIAARNGGSWNQYTGYRSGNPNVIYAGETVCRRTGTGTVATGGRYVVRSGDTLGGIAAYYRVNMYSIHGYRSGNPALIYPGETLYW

SEQ ID NO: 1251 - protein, 342 aa, unidentified
  REGION 1..342: note = Bacteriophage sp.
DDVLLQHEDRRGHAQDHRREHSHYDEGHRKARQHESGGLVVLKKLLKGCAAFVALASALVVGAPSAFAWQEIDYFIANGHGTISPSYLVIHSTANPGATAWNHVTYWNRAGNNTAMAQWVCDWTNGGTVYQVMPGNAKAWHVGNGNNVSVGIEICEGTTREQVDTALDTAAQWAAYYLNQKGWGIDRMVSHNDARALWGGTTHTDPIPYLARWGYSWNWFKSKVQSYMDCSTVTEPAPDSGNQNNAPAHPTDSVEALAAAVMRGEYGSGQARRDALGSRYEEVQAYVNSHYFGIGSSSKTTAELAAAVMRGEYGSGQARRDALGSRYDDVQDYVNKHYYSIY

SEQ ID NO: 1252 - protein, 489 aa, unidentified
  REGION 1..489: note = Caudoviricetes sp.
MASARKCATTSSTRTYRRTGIDAPHDRGRHLPAAARLVARLQSWRAQALIFTPVFKAIPFRDGFSICPLTWGREGEDVGILNNKGKPKHKRLRRHMGRPLTALAAVLCVAVAPVASANMNVIDVSGWQSADVTRVVDADAAIVKITEGGGYVNPSWRSQTDWTRQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDRVMAIVNQRLGGSGGAPAAVNCGSLCVTVKSGDTLSSIAASNGGSWNQWTGYRSGNPNVIYAGETVCRRTGTGTVATGGRYVVRSGDTLGGIAAYYRVNMYSIHGYRSGNPALIYPGETLYW

SEQ ID NO: 1253 - protein, 328 aa, unidentified
  REGION 1..328: note = Caudoviricetes sp.
MIKSGLTDVVVEANSNNYTEGRRGYKVCKITPHHMAGVLSAEACGRIFQNANRQASSNYGIGNDGKIACYVGEENRAWTSSNRANDCQAITIEVSNSSVGGKYPISEAAWKSLVRLCVDICKRYNFRLTYDGTPNGSLTRHNMFANTNCPGAYLQSKFPELVKEVNSQLDGGETSTPVQETKSIVDLANEVIAGKYGNGEARKQALGSLYDEVQAKVNEILGAKKTESKQTLKSIDEVAREVINGAWGNGQDRFNRLAAAGYDGNAVQNRVNEILGAKSTTSNKKSNETIANEVIQGKWGNGADRKSRLQAAGYDYNAIQAIVNAKLK

SEQ ID NO: 1254 - protein, 384 aa, unidentified
  REGION 1..384: note = Caudoviricetes sp.
MLCVAVAPVASANMNVIDVSGWQSADVTRVVDADAAIVKITEGGGYVNPSWRSQTDWARQTGKACGGYHYADGGDVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIAAGDRGKTNAEVRHDPVRPQVTATPDYNDMATKVIRGVYGNGNERRAALGGAYDTVMAIVNQRLGGSGVAPAAVNCGSVCVTVKSGDTLSTIAERNGGSWNQYTGYRSGNPNVIYAGETVCRRTGTGTVATGGRYVVRSGDTLGGIAAYYRVNMYSIHGYRSGNPALIYPGETLYW

SEQ ID NO: 1255 - protein, 310 aa, unidentified
  REGION 1..310: note = Caudoviricetes sp.
MTLRGIDIASYQAGIDLSRVPCDFVIVKATEGVNYVNPDCDRAVQQAIRLGKCWGTYHYVDGSGAVAEADYYVNNIKGYLGKGILCIDWESGSNRAWGNYAYLDALVSRVIERTGIKPLIYVQASAYAPTSAVAQRHDCGLWIAQYADMNATGYQDTPWNEGAYSCAIRQYSSAGRLNGWNGNLDLDKFYGDANAWRKYAGASGAATPTPKPVDPLAGKSDNQLADEVIAGKYGDGENRKRALGNRYNAVQAIVNQKLGGGHQSRTYTVRAGDTLSGIAARYGTTWQHLQQINGIRDANLIFAGQVLRID

SEQ ID NO: 1256 - protein, 489 aa, unidentified
  REGION 1..489: note = Caudoviricetes sp.
MASARKCATTSSTRTYRRTGIDAPHDRGRHLPAAARLVARLQSWRAQALIFTPVFKAIPFRDGFSICPLTWGREGEDVGILNNKGKPKHKRLRRHIGKPLTALAAVLCVAVAPVASANMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNRRLGGSVGASTAVNCGSLCVTVKSGDTLSSIAASNGGSWNQWTGYRSGNPNVIYAGETVCRRTGTGTVATGGRYVVRAGDTLGGIAAYYRVNMYSIHGYRSGNPALIYPGETLYW

SEQ ID NO: 1257 - protein, 402 aa, unidentified
  REGION 1..402: note = Bacteriophage sp.
MGRPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTTAPDYNDMATKVIRGVYGNGNERRQALGGAYDRVMAIVNQRLGGGSTVSAPANTNCGSVCVTVKSGDTLSTIASRNGGSWNQYTGYRSGNPNIIYAGETVCRRGTGVARQPVSNTYSTHRYTVRSGDTLSTIAGYYRVNMYSIHGYRSGNPALIYPGETLYW

SEQ ID NO: 1258 - protein, 306 aa, unidentified
  REGION 1..306: note = Bacteriophage sp.
MLKKLVKGCAAFVALASALVVGAPSAFAWQEIDYFIANGHGTISPSYLVIHSTANPGATAWNHVTYWNRAGNNAAMAQWVCDWTNGGTVYQVMPGNAKAWHVGNGNNVSVGIEICEGTTREQVDTALDTAAQWAAYYLNQKGWGVDRMVSHNDARTLWGGTTHTDPIPYLERWGYSWNWFKSKVQAYMDGSTGTEPAPDSGNQNNAPAAPTGSVEALAAAVMRGEYGSGQARRDALGSRYEEVQAYVNSHYFGIGSGASSGYKTTAELAAAVMRGDYGSGQARRDALGSRYNEVQTYVNRVYYKIY

SEQ ID NO: 1259 - protein, 386 aa, unidentified
  REGION 1..386: note = Caudoviricetes sp.
MVFNAHAKGMCLKDMKESDIVSLQGIDVSSWQNGIDVSKVPCDFVIAKATQGTNYVNPDCDRVVQQAIKSGKCWGTYHYVDGSGAVAEADYYVNNVKGYVGKGVLCIDWESAQNGAWGNYGYLDALVARVIERTGVKPLIYAQASVYAQTAAVAKKYDCGLWIAQYADTNATGYQGTPWNEGAYSCAIRQYSSAGRLPGWGGNLDLNKFYGDAAAWQKYAGASGTPAPAPAPADPLAGKSDAQLADEVIAGKFGDGDNRKRALGNRYDAVQAVVNQKLGASGTTATQTYTVKSGDTLSGIASKYGTTWQALQQINGIADANKIYPGQVLKVTGSAAAPAAKTYTVKSGDTLSGIAAKYGTTWQHLQQINGIADANRIYPGQVLRVG

SEQ ID NO: 1260 - protein, 375 aa, unidentified
  REGION 1..375: note = Caudoviricetes sp.
MDVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYANMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSAGTVSNTSNCGSVCVTVRSGDTLSSIAASNGGSWNQYTGYRSGNPNVIYAGETVCRRTGAASTATVATGGRYVVRSGDTLGGIAAYYRVNMYSIHGYRSGNPALIYPGETLYW

SEQ ID NO: 1261 - protein, 429 aa, unidentified
  REGION 1..429: note = Bifidobacterium adolescentis L2-32
MAFLFLKEVCLKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPMVYVQDSAVYQIPSDVRSHCMLWKAQYASMNATGWQSTPWNAGSKGEGMVQYASTGYLNGVGPLDLNLFFGERDAWQKIANGDRGKTKTEVRHDPVKPQVTTTPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLSGIAGYYKVNMYSIHGYRSGNPALIYPGETLYW

SEQ ID NO: 1262 - protein, 140 aa, unidentified
  REGION 1..140: note = Streptococcus agalactiae BSU92
MTKCDFEVGHKPIDKIGLLAKEVLEGKYGDGEERRRNLGCLYDLVQTRVNYMVHERDSKFTGIKIYDNVDKPSHYQGKNGMEAIDVVRNFIGNLTGVSAFYWGNSMKYLLRFQGKNGLEDLKKARKNLDWLIEEMEKEND

SEQ ID NO: 1263 - protein, 419 aa, unidentified
  REGION 1..419: note = Bifidobacteriaceae bacterium MCC01943
MGILNKGNPKHKRLRRHIGRPLTALAAVLCVAVAPVASANMNVIDVSGWQSADVTRVVDADAAIVKITEGGGYVNPSWRSQTDWARQTGKACGGYHYADGGNVTAEVNHYLNQFSGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLGGIAAYYRVNMRSIHGYRSGNPALIYPGETLYW

SEQ ID NO: 1264 - protein, 415 aa, unidentified
  REGION 1..415: note = Bifidobacteriaceae bacterium MCC01954
MGILNNKGKPKHKRLRRHIGRPLTALAAVLCVAVTPVASANMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQRIAAGDRGKTNAEVRHDPVRPQVTATPDYNDMATKVIRGVYGNGNERRQALGGAYDTVMAIVNQRLGGSGGAPAAANCGSVCVTVRSGDTLSTIAARNGGSWNQYTGYRSGNPNVIYAGETVCRRAGAASTATVATGGRYVVRSGDTLSGIAARLGIGYTQLTGYRSGNPNVIYPGEVLHY

SEQ ID NO: 1265 - protein, 412 aa, Bifidobacterium adolescentis
MGILNNKGKPKHKRLRRHMGRPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGAPAAVNCGSLCVTVKSGDTLSSIAASNGGSWNQWTGYRSGNPNVIYAGETVCRRTGTGTVATGGRYVVRSGDTLGGIAAYYRVNMYSIHGYRSGNPALIYPGETLYW

SEQ ID NO: 1266 - protein, 412 aa, Bifidobacterium adolescentis
MGILNNKGKPKHKRLRRHMGRPLTALAAVLCVAVAPVASADMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYANMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSVGTSAAVNCGSVCVTVRSGDTLSTIAARNGGSWNQYTGYRSGNPNVIYAGETVCRRTGTGTVATGGRYVVRSGDTLGGIAAYYGVNMYSIHGYRSGNPALIYPGETLYW

SEQ ID NO: 1267 - protein, 202 aa, Solobacterium sp.
MPTFNSNSNGTKNNPTNNASKAGMPSNLPKSATVSSRPASKAGMPSNLPKTAPAAVKPAKKPLDEIVKEVIDGAWGAGADRKAKLEAAGYDYNMVQRAVNRVEGASVAELTAVVDQVIRGEFGNGADRKAKLEAAGFDYDKVQAAVNAKLAGKPIAPAGNRDDIAKAVIRGEYGNGADRKAKLEAAGYDYNAVQARVNELLK

SEQ ID NO: 1268 - protein, 43 aa, Solobacterium sp.
NRDDIAKAVIRGEYGNGADRKAKLEAAGYDYNAVQARVNELLK

SEQ ID NO: 1269 - protein, 412 aa, Bifidobacterium catenulatum
MGILNNKGKPKHKRPCRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPILYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDTVMAIVNQRLGGSGGASSAANCGSVCVTVKSGDTLSSIAASNGGSWNQYTGYRSGNPNVIYAGEIVCRRTGTGTVATGGRYVVRSGDTLGGIAAYYRVNMYSIHGYRSGNPALIYPGETLYW

SEQ ID NO: 1270 - protein, 287 aa, unidentified
  REGION 1..287: note = Bacilli bacterium
MNIRTTKPGAGNKFYITKSKGGYSSCIQGSPTDSQCNVLDNCVGYACGRFNEIIGSMKYPSLNCNAEIFIERARNTYGLEISPVPTLGGIMVWQKGATLSGNDGAGHVAVVEKIIDSNTIYTSESGYGSSAFWNSTRRNSNGRWGLGSGYTFRGCIVNPAIGKITAPTTNTSNTDIANKSVDELAREVIAGKYGNGDARKSALGSRYSEVQAKVNEMLAGNSTPSAPTPAPKPQVDILELVKKTIRGDFGNGEARRKALGSNYDEVQRQVNLNLKNGLTRWDNIKLF

SEQ ID NO: 1271 - protein, 411 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGASTAVNCGSLCVTVKSGDTLSSIAASNGGSWNQWTGYRSGNPNVIYAGETVCRRTGTGTVATGGRYVVRSGDTLGGIAAYYGVNMYSIHGYRSGNPALIYPGETLYW

SEQ ID NO: 1272 - protein, 412 aa, Bifidobacterium adolescentis
MGILNNKGKPKHKRLRRHMGRPLTALAAVLCVAVAPVASANMNVIDVSGWQSADVTRVVDADAAIVKITEGSGYVNPSWRSQTDWTRQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVKHDPVRPQVTATPDYNDMATKVIRGVYGNGNERRQALGGAYDTVMAIVNQRLGGSGGAPAAVNCGSVCVTVRYGDTLSTIAARNGGSWNQWTGYRSGNPNVIYAGETVCRRTGTGTVATGGRYVVRSGDTLGGIAAYYGVNMYSIHGYRSGNPALIYPGETLYW

SEQ ID NO: 1273 - protein, 412 aa, Bifidobacterium adolescentis
MGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDRVMAIVNQRLGGSSGAPAAANCGSVCVTVRSGDTLSTIAARNGGSWNQYTGYRSGNPNVIYAGEIVCRRTGTGTVATGGRYVVRSGDTLGGIAAYYRVNMYSIHGYRSGNPALIYPGETLYW

SEQ ID NO: 1274 - protein, 474 aa, Streptococcus suis
MALNMEQAIAWMEARRGKVTYSMDYRNGPNSYDCSSAVYYALLSAGAISAGWAVNTEYEHDWLIKNGFKLIAENSVFAAQRGDIFIWGKRGQSAGAGGHTGIFVDSNNIIHCNYARNGITVDGYLAIARASGNKYYYIYRPHGQSTVSASTAGKSIDQLVQETLAGKYGNGDVRKTILGNQYQAVMDRINGKTSAVQKTDEELAREVLAGKHGNGEERKRSLGSRYDAVQKKVDELLKKPASPQPAPKVEAPKVETPKVTPSKAEAPVFAEDGDLKFNGAILKKEVLNKILAKCKEHDILPSYAITILHYEGLWGTSAVGKADNNWGGMTMPSNDLQITRPSGVVVTRGLARPSNEGGYYMHYASVDDFLTDWFWLLRKDGSYKVSGAKTFSDSVKGMFKIGGAKYDYAASGYESYLVGASSRLKAIESENGSIAKYDKQTIADVGSTDKIEVNIEGIEISINGVTYTLSKKPI

SEQ ID NO: 1275 - protein, 281 aa, unidentified
  REGION 1..281: note = Mycoplasmatota bacterium
MNVRTTKPTSGNKFFITKSKGGYSTCIQGSPTDSQCNVLANCVGYACGRFNEIIGAMKYPSLNCNAENFIERAKNTYGLEISSVPTLGGIMVWQKGTLSGNDGAGHVAIVEKIIDSNTIYTSESGYGGSAFWNSTRRNTNGRWGLGSAYTFRGCIVNPAIGKVVAPTPTPSAKKSVDEVAKEVIRGEWGNGDERYNRLTNAGYNYNEVQAKVNELLNSNKPTPAPTPSVDILDLVRKTIRGDFGNGEARRKALGSNYDEVQRQVNLNLKNGLTRWDNIKLF

SEQ ID NO: 1276 - protein, 287 aa, Carnobacterium sp.
MIRILRDFVMKDSGFLESFDFVVIHNDAGRMKPQRYIPFLKNRNKALGIAHFYCNRDTIVQVVPIENIGYHTGDWWSNCRSVGYEVCESLSASDEEFLQNEDITLLKAAADLIEAGMPISRDTVRLHHEFVPTSCPHRSMELHGGTTESVRAYFIERMQYFASLGNNLAEILHAYFPEEEFRMKTWEHYEVFNDDNEVVRQVMRGEWGVGQERIQQLTDAGYDAERIQEKVNLALQGSQKNDTKTTDTLAYEVIQGDWGNGEERKERLEAAGYDYDAVQQRVNELLG

SEQ ID NO: 1277 - protein, 419 aa, Bifidobacterium sp.
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTKTEVRHDPVKPQVTTTPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLSGIAGYYRVNMYSIHGYRSGNPALIYPGETLYW

SEQ ID NO: 1278 - protein, 414 aa, Bifidobacterium adolescentis
MGILNKGNPKHKRLRRHIGKPLTALAAVLCVAVAPVASANMNVIDVSGWQSADVTRVVDADAAIVKITEGSGYVNPSWRSQTDWTRQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVKHDPVRPQVTATPDYNDMATKVIRGVYGNGNERRQALGGAYDTVMAIVNQRLGGSGGAPAAVNCGSVCVTVRYGDTLSSIAASNGGSWNQWTGYRSGNPNVIYAGETVCRRTGAASTSTVATGGRYVVRSGDTLGGIAAYYGVNMYSIHGYRSGNPALIYPGETLYW

SEQ ID NO: 1279 - protein, 419 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTKTEVRHDPVKPQVTTTPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLSRIAGYYRVNMYSIHGYRSGNPALIYPGETLYW

SEQ ID NO: 1280 - protein, 196 aa, unidentified
  REGION 1..196: note = Bifidobacterium eulemuris
MRRFVGAVVALSLVVSVAACGEADASGPVVSEPVVAAPAPEPEPAPEPEPEPVSEPAPAPEPEPAPVPSVEELAAAVIRGEYGNGQARRDALGDRYDEVQALVDSLMPAPAPVVGSAPVAAPVVVEPAVPEPAPEPEPVASSPSAAGIPACVFEDGSDPATGDYMPVCYWDGLTMGNGAGASYVLVDGVPVDGWAW

SEQ ID NO: 1281 - protein, 374 aa, Bifidobacterium breve
MNVIDVSGWQSADVTRVVDADAAVVKITEGSGYVNPSWRSQTDWARQTGKACGGYHYADGGNVTAEVSHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQRIAAGDRGKTNAEVRHDPVRPQVTATPDYNDMATKVIRGVYGNGNERRQALGGAYDTVMAIVNQRLGGSGGAPAAANCGSVCVTVRSGDTLSTIAARNGGSWNQYTGYRSGNPNVIYAGETVCRRGGTAATPAYAGGGRYTVRAGDTLGGIAARLGISYTQLTGYRSGNPNVIYPGEVLHY

SEQ ID NO: 1282 - protein, 305 aa, Bifidobacterium pseudocatenulatum
MNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDRVMAIVNQRLGGSGVAPAAANCGSVCVTVRSGDTLSSIAARNGGSWNQYTGYRSGNPNVIYAGEIVCRRTGTGTVATGGRYVVRSGDTLGGIAAYYRVNMYSIHGYRSGNPALIYPGETLYW

SEQ ID NO: 1283 - protein, 428 aa, Bifidobacterium pseudocatenulatum
MAFLLPLDLGREGEDVGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDTVMAIVNQRLGGSAGTVSNTSNCGSVCVTVRYGDTLSTIAASNGGSWNQYAGYRSGNPNVIYAGETVCRRTGTGTVATGGRYVVRSGDTLGGIAAYYRVNMYSIHGYRSGNPNVIYPGETLYW

SEQ ID NO: 1284 - protein, 196 aa, unidentified; identical to SEQ ID NO: 1280
  REGION 1..196: note = Bifidobacterium eulemuris

SEQ ID NO: 1285 - protein, 415 aa, Bifidobacterium breve
MGILNNKGKPKHKRLRRHIGRPLTALAAVLCVAVTPVASANMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQRIAAGDRGKTNAEVRHDPVRPQVTATPDYNDMATKVIRGVYGNGNERRAALGGAYDTVMAIVNQRLGGSGGAPAAANCGSVCVTVRSGDTLSSIAARNGGSWNQWTGYRSGNPALIYPGETVCRRTGPSVAPAYAGGGRYVVRAGDTLGGIAAYYGVNMYSIHGYRSGNPALIYPGETLYW

SEQ ID NO: 1286 - protein, 280 aa, unidentified
  REGION 1..280: note = unclassified Gemella
MVKKINVSLMNVGKLTSIDFVVIHNDYGSMTPEQYVNWLRGRNKNLGIAHYYITKDCIARVIDTYNIGYHTGEWNSNCRSIGYEVCQSRSASDVDFIANEDMTLMQATEDLIFYGLPINHQTVRLHHEFVSTSCPHRSLELHGNTTQSVKNYFISRMKYFATLGKTVDEMLGNKKTLKQPQTTSNNKTLDQLADEVIRGIWGNGKERIQRLSNAGYNPVDVQRRVDEKKGKIKPSLKPLDEVAREVINGKWGNGQDRINRLTRAGYNHNDVQAKVNEILG

SEQ ID NO: 1287 - protein, 414 aa, Bifidobacterium adolescentis
MGILNKGNPKHKRLRRHIGKPLTALAAVLCVAVAPVASANMNVIDVSGWQSADVTRVVDADAAIVKITEGSGYVNPSWRSQTDWTRQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGAPAAVNCGSVCVTVRYGDTLSSIAASNGGSWNQYTGYRSGNPNVIYAGETVCRRTGAASTSTVATGGRYVVRSGDTLGGIAAYYGVNMYSIHGYRSGNPALIYPGETLYW

SEQ ID NO: 1288 - protein, 416 aa, Bifidobacterium catenulatum
MGILNNNKGKPKHKRLRRHIGKPLTALAAVLCVAVAPVASADMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYANMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSVGASTAVNCGSVCVTVRSGDTLSTIAARNGGSWNQWTGYRSGNPNVIYAGETVCRRTGAASTATVATGGRYVVRSGDTLGGIAAYYRVNMYSIHGYRSGNPALIYPGETLYW

SEQ ID NO: 1289 - protein, 412 aa, unidentified
  REGION 1..412: note = Streptococcus ruminantium
MGIDFETSIRWMMDRVGRVTYSMDYRNGPDSYDCSSAVYYALTAGGAISAGWAVNTEYEHDWLMNNGFELVAENTAWDAKCGDIFIWGRRGESAGAGGHTGIFVDGDNIIHCNYAHNGISVNEHDATWSYAGRPYYYVYRLKDQSETTTSNQKTDEELAQEVIAGLHGFGEERKYSLGSRYDAVQAKVNEILNGGPNAAEESPVVQLKEDGDLSFNGAILKKSILDTILKKCAEYDILPSYAITVLHFEGLWGASAIGKADNNWGGMTMNSDVDTIQRPSGVTVTRGIARPSNEGGYYMHYATIEDFLTDWFYLLRAGGSYKVSGAKTFSEAVKGMFQVGGAVYDYAAAGYDNYLVGMASRLKAIEAENGSLEKFDTVADIGNSSRDQIDVNIEGIEVIINGITYKLEKKPV

SEQ ID NO: 1290 - protein, 415 aa, Bifidobacterium adolescentis
MGILNNKGKPKHKRLRRHIGKPLTALAAVLCVAVAPVASADMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTVTPDYNDMATKVIRGVYGNGNERRQALGGAYDTVMAIVNQRLGGSGGASSAANCGSVCVTVRYGDTLSSIAARNGGSWNQYTGYRSGNPNVIYAGETVCRRTGAASTSTVATGGRYVVRSGDTLGGIAAYYRVNMYSIHGYRSGNPALIYPGETLYW

SEQ ID NO: 1291 - protein, 412 aa, Bifidobacterium catenulatum
MGILNNKGKPKHKRLRRHMGRPLTALAAVLCVAVAPVASADMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYANMNATGWQSTPWNAGSKGEGMVQYASTGYLNGVGPLDLNLFFGERDAWQKIANGDRGKTHAEVRHDPARPQVTATPDYNDMATKVIRGVYGNGNERRQALGGAYDTVMAIVNQRLGGSVGTSATVNCGSVCVTVKSGDTLSSIAASNGGSWNQWTGYRSGNPNVIYAGETVCRRTGAGTVATGGRYVVRSGDTLGGIAAYYGVNMYSIHGYRSGNPALIYPGETLYW

SEQ ID NO: 1292 - protein, 419 aa, Bifidobacterium adolescentis
MGILNKGNPKHKRLRRHIGRPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLGGIAAYYRVNMYSIHGYRSGNPALIYPGETLYW

SEQ ID NO: 1293 - protein, 413 aa, Bifidobacterium pseudocatenulatum
MGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDTVMAIVNQRLGGSAGTVSNTSNCGSVCVTVRYGDTLSTIAASNGGSWNQYAGYRSGNPNVIYAGETVCRRTGTGTVATGGRYVVRSGDTLGGIAAYYRVNMYSIHGYRSGNPNVIYPGETLYW

SEQ ID NO: 1294 - protein, 419 aa, Bifidobacterium adolescentis
MGILNKDNPKHKRLRRHIGKPLTALAAVLCVAVAPVASANMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVRHDPVKPQVTTTPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLSRIAGYYRVNMYSIHGYRSGNPALIYPGETLYW

SEQ ID NO: 1295 - protein, 412 aa, Bifidobacterium adolescentis
MGILNNKGKPKHKRLRRHIGKPLTALAAVLCVAVAPVASADMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYANMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGAPATANCGSICVTVRYGDTLSTIAARNGGSWNQYTGYRSGNPNVIYAGETVCRRTGTGTVATGRRYVVRSGDTLGGIAAYYRVNMYSIHGYRSGNPALIYPGETLYW

SEQ ID NO: 1296 - protein, 415 aa, Bifidobacterium ruminantium
MGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGVAPAAANCGSVCVTVRSGDTLSSIAARNGGSWNQYTGYRSGNPNVIYAGETVCRRTGAASTATVATGGRYVVRSGDTLGGIAAYYRVNMYSIHGYRSGNPALIYPGETLYW

SEQ ID NO: 1297 - protein, 412 aa, Bifidobacterium adolescentis
MGILNNKGKPKHKRPCRHIGKPLTALAAVLCVAIAPIASANMNVIDVSGWQSADVTRVVDADAAIVKITEGGGYVNPSWRSQTDWARQTGKACGGYHYADGGNVTAEVNHYLNQFSGYVGQCVLALDWESYGNHAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDRVMAIVNQRLGGSGGASTAVNCGSLCVTVKSGDTLSSIAASNGGSWNQWTGYRSGNPNVIYAGETVCRRTGTGTVATGGRYVVRSGDTLGGIAAYYRVNMYSIHGYRSGNPALIYPGETLYW

SEQ ID NO: 1298 - protein, 413 aa, Bifidobacterium pseudocatenulatum
MGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGDVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSAGTVSNTSNCGSVCVTVRSGDTLSSIAASNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1299 - protein, 413 aa, Bifidobacterium pseudocatenulatum
MGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDTVMAIVNQRLGGSAGTVSNTSNCGSVCVTVRYGDTLSSIAASNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1300 - protein, 332 aa, unidentified
  REGION 1..332: note = Streptococcus ruminantium
CGDIFIWGRRGESAGAGGHTGIFVDGDNIIHCNYAHNGISVNEHDATWSYAGRPYYYVYRLKDQSETTTSNQETDEELAQEVIAGLHGFGEERKYSLGSRYDAVQAKVNEILNGGPNAAEESPVVQLKEDGDLSFNGAILKKSILDTILKKCAEYDILPSYAITVLHFEGLWGASAIGKADNNWGGMTMNSDVDTIQRPSGVTVTRGIARPSNEGGYYMHYATIEDFLTDWFYLLRAGGSYKVSGAKTFSEAVKGMFQVGGAVYDYAAAGYDNYLVGMASRLKAIEAENGSLEKFDTVADIGNSSRDQIDVNIEGIEVIINGITYKLEKKPV

SEQ ID NO: 1301 - protein, 411 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGAPAAVNCGSLCVTVKSGDTLSSIAASNGGSWNQWTGYRSGNPNVIYAGETVCRRTGTGTVATGGRYVVRSGDTLGGIAAYYRVNMYSIHGYRSGNPALIYPGETLYW

SEQ ID NO: 1302 - protein, 419 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPMVYVQDSAVYQIPSDVRSHCMLWKAQYASMNATGWQSTPWNAGSKGEGMVQYASTGYLNGVGPLDLNLFFGERDAWQKIANGDRGKTKTEVRHDPVKPQVTTTPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLSGIAGYYKVNMYSIHGYRSGNPALIYPGETLYW

SEQ ID NO: 1303 - protein, 415 aa, Bifidobacterium pseudocatenulatum
MGILNNKGKPKHKRLRRHMGRPLTALAAVLCVAVAPVASADMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYANMNATGWQSTPWNAGSKGEGMVQYASTGYLNGVGPLDLNLFFGERDAWQKIANGDRGKTNAEVKHDPVRPQVNATPDYNDMATKVIRGVYGNGNERRQALGGAYDTVMAIVNQRLGGSSGAPATANCGSVCVTVRYGDTLSTIAARNGGSWNQYTGYRSGNPNIIYAGETVCRRTGAASTATVATGGRYVVRSGDTLGGIAAYYGVNMYSIHGYRSGNPALIYPGETLYW

SEQ ID NO: 1304 - protein, 32 aa, unidentified
  REGION 1..32: note = Schaalia sp. ZJ1691
MNGKWGNGDERRRRLGNLYGQVHARVNAKLDY

SEQ ID NO: 1305 - protein, 415 aa, Bifidobacterium breve
MGILNNKGKPKHKRLRRHIGRPLTALAAVLCVAVTPVASANMNVIDVSGWQSADVTRVVDADAAVVKITEGSGYVNPSWRSQTDWARQTGKACGGYHYADGGNVTAEVSHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQRIAAGDRGKTNAEVRHDPVRPQVTATPDYNDMATKVIRGVYGNGNERRQALGGAYDTVMAIVNQRLGGSGGAPAAANCGSVCVTVRSGDTLSTIAARNGGSWNQYTGYRSGNPNVIYAGETVCRRGGTAATPAYAGGGRYTVRAGDTLGGIAARLGISYTQLTGYRSGNPNVIYPGEVLHY

SEQ ID NO: 1306 - protein, 411 aa, Bifidobacterium adolescentis
MGILNKGNPKHKRLRRHIGRPLTALAAVLCVAVAPVASANMNVIDVSGWQSADVTRVVDADAAIVKITEGSGYTNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVKHDPVRPQVTAAPDYNDMATKVIRGVYGNGNERRQALGGAYDTVMAIVNQRLGGSGGASSAANCGSVCVTVRGGDTLSSIAARNGGSWNQYTGYRSGNPNVIYAGETVCRRTGTATVATGGRYVVRAGDTLGGIAAYYRVNMYSIHGYRSGNPALIYPGETLYW

SEQ ID NO: 1307 - protein, 416 aa, Bifidobacterium pseudocatenulatum
MGILNNKGKPKHKRPYRHIGRPLTALAAVLCVAVAPVASANMDVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYANMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSAGTVSNTSNCGSVCVTVRSGDTLSSIAASNGGSWNQYTGYRSGNPNVIYAGETVCRRTGAASTATVATGGRYVVRSGDTLGGIAAYYRVNMYSIHGYRSGNPALIYPGETLYW

SEQ ID NO: 1308 - protein, 415 aa, Bifidobacterium adolescentis
MGILNNKGKPKHKRLRRHIGKPLTALAAVLCVAVAPVASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERGAWQKIANGDRGKTHAEVRHDPVRPQVTVTPDYNDMATKVIRGVYGNGNERRQALGGAYDTVMAIVNQRLGGSGVASAAVNCGSVCVTVRYGDTLSSIAARNGGSWNQYTGYRSGNPALIYPGETVCRRTGAASTSTVATGGRYVVRSGDTLGGIAAYYGVNMYSIHGYRSGNPALIYPGETLYW

SEQ ID NO: 1309 - protein, 412 aa, Bifidobacterium pseudocatenulatum
MGILNNKGKPKHKRLRRHIGKPLTALAAVLCVAVAPVASANMNVIDVSGWQSADVTRVVDADAAIVKITEGGGYVNPSWRSQTDWTRQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDTVMAIVNQRLGGSGVAPAAANCGSLCVTVRSGDTLSSIAARNGGSWNQYTGYRSGNPNVIYAGETVCRRTGTGTVATGGRYVVRSGDTLGGIAAYYRVNMYSIHGYRSGNPALIYPGETLYW

SEQ ID NO: 1310 - protein, 374 aa, Bifidobacterium pseudocatenulatum
MNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRSHCMLWKAQYANMNATGWQSTPWNAGSKGEGMVQYASTGYLNGVGPLDLNLFFGERDAWQKIANGDRGKTNAEVKHDPVRPQVNATPDYNDMATKVIRGVYGNGNERRQALGGAYDTVMAIVNQRLGGSSGAPATANCGSVCVTVRYGDTLSTIAARNGGSWNQYTGYRSGNPNIIYAGETVCRRTGAASTATVATGGRYVVRSGDTLGGIAAYYGVNMYSIHGYRSGNPALIYPGETLYW

SEQ ID NO: 1311 - protein, 289 aa, unidentified
  REGION 1..289: note = uncultured Clostridium sp.
MGFNMRTSKPSAGNKFYNNGNNGGYSWCINGNPTDKGCNVLANCVGYACGRFNEIIGSMKYKALCCNAENFIERAKQAELQVVSYPTLGGIMVWQKGSTLSGNDGAGHVAVVERIDSANQIYTSESGYGSSAFWNSIRRNDNGRWGLGSGYTFRGCIVNPAIGDVHYVAPVNPQPSAPNSDISNKSVDELAKEVIAGKYGNGEDRKNALGSRYSEVQARVNEILNGNKPSQPSTPSVDILTLVKKTIRGDYGNGSARRNALGSNYDEVQKQVNLNIKNGTTNWNNIRLY

SEQ ID NO: 1312 - protein, 413 aa, unidentified
  REGION 1..413: note = uncultured Bifidobacterium sp.
MGILNNKGKPKHKRLRRHVGKPLTALAAVLCVAVAPVASANMNVIDVSGWQSADVTRVVDADAAIVKITEGSGYTNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSAGTVSNTSNCGSVCVTVRSGDTLSSIAASNGGSWNQYTGYRSGNPNVIYAGETVCRRTGTGTVATGGRYVVRSGDTLGGIAAYYGVNMYSIHGYRSGNPALIYPGETLYW

SEQ ID NO: 1313 - protein, 414 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGASTAVNCGSVCVTVRYGDTLSSIAARNGGSWNQWTGYRSGNPNVIYAGETVCRRTGAASTATVATGGRYVVRSGDTLGGIAAYYRVNMYSIHGYRSGNPALIYPGETLYW

SEQ ID NO: 1314 - protein, 255 aa, Bifidobacterium adolescentis
VQDSAVYQIPSDVRSHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYDTVMAIVNQRLGGSGGASTAVNCGSVCVTVRYGDTLSSIAARNGGSWNQWTGYRSGNPNVIYAGETVCRRTGAASTATVATGGRYVVRSGDTLGGIAAYYRVNMYSIHGYRSGNPALIYPGETLYW

SEQ ID NO: 1315 - protein, 415 aa, Bifidobacterium pseudocatenulatum
MGILNNKGKPKHKRLRRHIGKPLTALAAVLCVAVAPVASANMNVIDVSGWQSADVTRVVDADAAIVKITEGSGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVKHDPVRPQVTATPDYNDMATKVIRGVYGNGNERRQALGGAYDTVMAIVNQRLGGSGGASTAVNCGSVCVTVKSGDTLSSIAARNGGSWNQYTGYRSGNPNVIYAGETVCRRTGTTSTATVATGGRYVVRSGDTLSDIAAYYGVNMYSIHGYRSGNPALIYPGETLYW

SEQ ID NO: 1316 - protein, 420 aa, unidentified
  REGION 1..420: note = Bifidobacterium faecale
MGILNNKGKPKHKRPCRHIGKPLTALAAVLCVAIAPIASANMNVIDVSGWQSADVTRVVDADAAIVKITEGGGYVNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDRVMAIVNQRLGGGSTVSAPANTNCGSVCVTVKSGDTLSTIAARNGGSWNQYTGYRSGNPNIIYAGETVCRRGTGVARQPVSNTYSTHRYTVRSGDTLGGIAAYYRVNMYSIHGYRSGNPALIYPGETLYW

SEQ ID NO: 1317 - protein, 317 aa, unidentified
  REGION 1..317: note = Arthrobacter phage CaptnMurica
MAPLPITGINEQYNAVYFTAGPTEKDGIVIHWWGLPQGQGIDSVRTTFGNGGRQASAHFGATDGQVDCYVNPDDVAWANGNWAANLSKISIECNPRQSDGDYYAAAWTIAYIRSIYGDLPLSRHWDYYPTQCCGTYDLNRLDQLAYDIAALGIGSNPPATPAAPVVPAPAAPATQTKSIDQLAQEVIAGAYGTGDARRAALGGQYAAVQARVNEILSGSSNPKPQPDINALVDAVLRGEYGNGDQRITALGNQYQAVQNEINRRAGISAPVTVPSAPNIEDLVRRTLAGEFGNGDDRVRALGANYTAVQAEINRRYA

SEQ ID NO: 1318 - protein, 418 aa, unidentified
  REGION 1..418: note = Caudoviricetes sp.
MTRFRKRLMAILAAVLAMFTITPMAFADMQGIDVSNWQCGIDIAGTQADFVVVGTTWGTGQVYNNCLVSGVNTDANRMIAQAQASGKRFGLYHYAMGGSPEGEAQFFYRNTSNYWRHGIVALDWEMDDNPAWGNWDWVRRFMAECERLSGGVRPLLYTGPVAGPIPQDIRDRYGLWIAQYANMSPTGYQANPWMIGAYGEAMRQYSGTGVVNTWSPIDLNLFRGDAWQWDLYANPTGGSTPPATPSAPVQPNTPPANTNTGGISHVMQWGETIWGLAVAYNAWPLSAWHTPSGDINRYYAGDIVTYGGGSTATPAPSVDYNALATAVIRGDYGNDPYRRQRLGGDYDKVMAIVNARLSGQAAPSYTDSNASNYGRSYVVRANDTLSGIAARYGISYTLIHGYRSGNPALIYPGEVLYW

SEQ ID NO: 1319 - protein, 372 aa, unidentified
  REGION 1..372: note = Bacteriophage sp.
MKGYLHGRERYYGVGEQRGIPNRCICDDVLLQHEDRRGHAQDHRREHSHYDEGHRKARQHESGGLVVLKKLLKGCAAFVALASALVVGAPSAFAWQEIDYFIANGHGTISPSYLVIHSTANPGATAWNHVTYWNRAGNNVAMAQWVCDWTNGGTVYQVMPGNAKAWHVGNGNNVSVGIEICEGTTREQVDTALDTAAQWAAYYLNQKGWGINRMVSHNDARTLWGGTTHTDPIPYLERWGYSWDWFKSKVQSYMDGSTGTEPVPDSGNQNNAPAHPTDSVEALAAAVMRGEYGSGQARRDALGSRYDEVQAYVNSHYFGIGSGFGSSHKTTAELAAAVMRGEYGSGQARRDALGSRYNEVQAYVNRHYFGIY

SEQ ID NO: 1320 - protein, 289 aa, unidentified
  REGION 1..289: note = Caudoviricetes sp.
MPKLRKQFAAIATILLAACMAVPLALADMNGIDVSGWQSPTITCTADYDFAVVKATQGTGFTNGYMTSQARCVTQRGKSLGFYHYAGGGNATREADYFVNTVHPYVGEAVLVLDWESYQNAAWGNSNWIRVFVNRVHERTGVWPLVYVSAAFIPQIPADVRANCGLWVAQYANNNPTGWQSRPWNYGKYGEAMRQYTSNGRINGYNGPLDLNYFRGTREQWDKYANPGKATKPAPAPASQPASSVDYEALATATIRGDYGNGEARRTALGANYGPVMRIVNQRLNGSAA

SEQ ID NO: 1321 - protein, 420 aa, unidentified
  REGION 1..420: note = Caudoviricetes sp.
MTRFRKRLMAFLAAVLAMFTFTPMAFADMQGIDVSNWQCGIDIANTQSDFIVVGTTWGTGQVYNNCLVSGVNTDANRMIAQAQASGKKFGLYHYAMGGNPEAEAQFFYRNTSNYWRHGIVALDWEMDDNPAWGDWDWVRRFMAECERLSGGVRPLLYTGPVAGTIPQDIRDRYGLWIAQYANMSPTGYQANPWLIGAYGEAMRQYSGTGVVNTWSPVDLNLFRGDAWQWDLYANPTGGSTPPATPAPSAPAQSSTPQPTPNTGGISHVMQWGETIWGLAVAYDAWPLSAWHTPSGDINRYYVGDVVTYGGGSTAIPAPSVDYNALATAVIRGDYGNDPYRRQRLGGDYDKVMAIVNARLSGQAAPSYTASNASNYGRSYVVRANDTLSGIAARYGISYTLIHGYRSGNPALIYPGEVLYW

SEQ ID NO: 1322 - protein, 167 aa, unidentified
  REGION 1..167: note = Caudoviricetes sp.
MVKGTVVIWDNCKYAPLSHVGFILSDNGDGTFMCLAQNAPKPYVTISKAYYDGIIGCFTPNQLLTAQNEEKPANTDINQKDTDTLAREVIAGVYGNGEDRKLALGSRYEDVQRKVNELLFNSQSVKENIAKQVINGDFGNGQERKDRLAQAGYDYNEIQAIVNQMLK

SEQ ID NO: 1323 - protein, 366 aa, unidentified
  REGION 1..366: note = Caudoviricetes sp.
MSLNGIDISNWQAGINLAAVPADFVIAKATQGTGYVSPDCARQVEQARATGKRFGVYHYVSGGNAVAEANHFVDSCINWVGAGLFCIDWESQENSAWGDEGYLEQVVAQVKARTGIPPLIYSSAAYYAQVAAVANRQNCGLWIAQYANNFPTGYQDTPWNEGAYACVIRQYSQAGRLPGYGGDLDLDKFYGDGATFDKYVTGGGNASNVSPSQPADSLAGRSDDDLANAVIRGEFGDGDARKQKLGGRYAAVQALVNQKLAAPVSSGQTYTVQPNDTLSTIAAKLGVDQSQISGFHSGNPDLIYPGEVLNISGGSPQPTAEYYTVQSNDNLSTIAASFGTSWQHIRDLNGLSNPDLIYPGQVLRVK

SEQ ID NO: 1324 - protein, 225 aa, unidentified
  REGION 1..225: note = Caudoviricetes sp.
MNELQRFIDRYNNQYLNTDGAYGAQCWDLFDKFCQDYNIDVSRYCSITGYAPDLFYLFDDYGYGTYFDKINVEDLQVGDWCFWDYGNMKHVALKVGANTYFSQNPNPSQVITLSPVGLIGGMRPKLENWTNEDVSHASMDETNVYALAIDVLNGRYGNGEERVNRLGAVYNAVQSKVNEYYDNTDLFISNVADGVIRGDYGNGEERVNRLGSIYQQVQDEVNTRY

SEQ ID NO: 1325 - protein, 401 aa, unidentified
  REGION 1..401: note = Caudoviricetes sp.
MPKLRKQFAAIAAILLAACMTVPLALADMNGIDVSGWQSPTVTCTADYDFAVVKATQGTGFTNGYMTSQARCVKQRGKSLGFYHYAGGGNATREADYFVNTVRPYVGEAVLVLDWESYQNAAWGNSNWIRVFVNRVHDRTGVWPLVYVSAAFIPQIPADVRANCGLWVAQYANNNPTGWQSRPWNYGKYGEAMRQYTSNGRINGYNGPLDLNYFRGTREQWDKYANPGKISKPAPTPAPQPAPSVDYEALATATIRGDYGNGESRRAALGANYGPVMRIVNQRLNGFAVYAPAASTRSVSVTVRRGDTMSGIAKRTGLWPLSAWSVPSGNISLIYPGNIVTYRGAVTSASSGSTTTGGHVYVVKSGETLSGIFGANGWQRVAQLNNLSNPNLIYPGQRLRY

SEQ ID NO: 1326 - protein, 307 aa, Bifidobacterium longum
MLVWLQQRGCEHTSQILGAVAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGCQRVAQLNSLANPNLIYPGQRLRY

SEQ ID NO: 1327 - protein, 307 aa, Bifidobacterium longum
MLVWLQQRGCEHTSQILGAVAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLNNLANPNLIYPGQRLRY

SEQ ID NO: 1328 - protein, 274 aa, Bifidobacterium breve
MAVGGDEMQESACLRHQFVGVVNVHERTGVWPLVYVSAAFIPQIPADVRANCGLWVAQYTNNNPTGWQSRPWNYGKYGEVMRQYTSNGRINGYNGPLDLNYFRGTREQWDKYANPGKSFKPTPMPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLTPI

SEQ ID NO: 1329 - protein, 308 aa, unidentified
  REGION 1..308: note = Bifidobacterium longum subsp. longum Bif16
MLVWLQQRGCEHTSQILGAVAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGPVMRIVNQRLNGSAAYAPAASTRSVNVTVRSGDTMSGIAKRTGLWPVTAWSVPSGNINLIYPGNVVTYQGAATAASSGSAATGGRVHVVKSGETLSGIFGANGCQRVAQLNNLANPNLIYPGQRLRY

SEQ ID NO: 1330 - protein, 493 aa, Bifidobacterium breve
MTKPVSIQQRIRILDAQGVSWREIARRLGMSRDTVRKYATMEDCSPKPAAGKGRRSLTDAHSGTVDSWLAADRLMPRKQRHTARRVYAKLVEEEGFEGSYSSVQRYVKRWRIGPTATAMADMNGIDVSGWQSPTVTCTADYDFAVVKATQGTGFTNGYMTSQARCVKQRGKSLGFYHYAGGGNATREADYFVNTVRPYVGEAVLVLDWESYQNAAWGNSNWIRVFVNRVHDRTGVWPLVYVSAAFIPQIPADVRANCGLWVAQYANNNPTGWQSRPWNYGKYGEAMRQYTSNGRINGYNGPLDLNYFRGTREQWDKYANPGKISKPAPTPAPQPAPSVDYEALATATIRGDYGNGESRRAALGANYGPVMRIVNQRLNGSAAYAPAASTRSVSVTVRSGDIMSGIAKRTGLWPLSAWSVPSGNINLIYPGNIVTYRGTATATRGSATTGGRVHVVKSGETLSGIFGANGWQRVAQLDNLANPNLIYPGQRLRY

SEQ ID NO: 1331 - protein, 447 aa, Bifidobacterium asteroides
MTMTMIRSPAWPQPVPPPIRAAFFMPTLRRICMQSSHARHSRAKPGYGRIMVGMLAVLAMLAPGIANADAGFDNASYQGCYDAQTARDSGASFSITKITEGTGYVNPAADCQLAANRAAGLRLGAYAYARPEKGNSPEAEADFFNAQASARGLVHAGVIPFLDWEPPASHRGDTQWAKRWLDRVASHWGTKPIIYMSASTIHAGDWSAVAGADYGLWVAGYPRGYVGERLRDPGAPPYSVSPWPFAAAWQYSSTGHVPGVGTAVDVNWFYGDAATWAKYANAPVGTQANPVTPSPTPSQGAPVGDADSIATAVIRGEYGNDPQRRALLGNRYDEVMAVVNERLQGGSDGGGGSGVYVVRSGDCLSAVFGGSWPTIARLNGISPPYVIHPGQRLATGSGGGGGGRTVTVQRGDTLSGIAARLGIPQSRLHGYRSGNPSLIYAGETLRY

SEQ ID NO: 1332 - protein, 404 aa, unidentified
  REGION 1..404: note = Bacteriophage sp.
MKYKLTKTARRIGLVIATVIVAMAMAIPANAANMIDISDWQRGINITTTGADIVVVKATESTTYVNTDCDRVVQQALSTDKGVGVYHFANTRNDPLAEADFFVQQTQGYIGKGIVPILDWEPGGPGNISWALTWLNRVESRWGAKPIIYMSQNTENKYDWTPVVQQNYGLWIAAYTLGFQPIYGFHPPNAQPVMKHWPFAVAWQYTSSGHVDGWPGNVDLSVVYGSIDTWRAYASGTGTIPAPPYPPKVTTPSSPSVDGTDEQLADRVIRGEFGSIPERQRRLGSRYAAVQAIVNARMGQSGVGATSGVCVVVRSGDTLSGIAARTGKTPYTMWGGYRSGNPNVLYAGETVCYRGANTGNQSSGGHVVRAGESLWAIYGSGWANAAARNGIRAPYVIHPGQVLR

SEQ ID NO: 1333 - protein, 254 aa, unidentified
  REGION 1..254: note = Bifidobacterium longum subsp. longum
MSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGPVMRIVNQRLNGSAAYAPAASTRSVNVTVRSGDTMSGIAKRTGLWPVTAWSVPSGNINLIYPGNVVTYQGAATAASSGSAATGGRVHVVKSGETLSGIFGANGCQRVAQLNNLANPNLIYPGQRLRY

SEQ ID NO: 1334 - protein, 418 aa, unidentified
  REGION 1..418: note = Bacteriophage sp.
MTRFRKRLMAILAAVLAMFTITPMAFADMQGIDVSNWQCGIDIANTQADFVVVGTTWGTGQVNNNCLVSGVNTDANRMIAQAQASGKKFGLYHYAMGGNPEAEAQFFYRNTSNYWRHGIVALDWEMDDNPAWGDWNWVRRFMAECERLSGGVRPLLYTGPVAGTIPQDIRDRYGLWIAQYANMSPTGYQASPWMLGAYGEAMRQYSGTGVVNTWSPIDLNLFRGEAWQWDLYANPTGSTAPAPATPAPVQPSTPPANTNTGGISHVMQWGETIWGLAVAYNAWPLSAWHTPSGDINRYYVGDVVTYGGGSTATPAPSVDYNALATAVIRGDYGNDPYRRQRLGGDYDKVMAIVNARLSGQAAPSYTAPNAPNYGRSYVVRAGDTLSGIAARYGISYTLIHGYRSGNPALIYPGEVLSW

SEQ ID NO: 1335 - protein, 416 aa, unidentified
  REGION 1..416: note = Bacteriophage sp.
MTRFRKRLMAFLAAVLAMFTITPMAFADMQGIDVSNWQCGIDIANTQADFVVVGTTWGTGQVNNNCLVSSVNTDANRMIAQAQASGKKFGLYHYAMGGNPEAEAQFFYRNTSNYWRHGIVALDWEMDDNPAWGNWDWVRRFMAECERLSGGVRPLLYTGPVAGTIPQDIRDRYGLWIAQYANMSPTGYQANPWMIGAYGEAMRQYSGTGVVNTWSPIDLNLFRGDAWQWDLYANPTGSTAPAPATPVQPSTPPANTNTGGISHTMQWGETIWGLAVAYNAWPLSAWHTPSGDINRYYVGDVVTYGGGSTATPAPSVDYNALATAVIRGDYGNDPYRRQRLGGDYDKVMAIVNARLSGQVAPSYTASNAPNYGRSYVVRANDTLSGIAARYGISYTLIHGYRSGNPALIYPGEVLYW

SEQ ID NO: 1336 - protein, 410 aa, unidentified
  REGION 1..410: note = Bacteriophage sp.
MAFLAAVLAMFTITPMAFADMQGIDVSNWQCGIDIANTQADFVVVGTTWGTGQVNNNCLVSGVNTDANRMIAQAQASGKRFGLYHYAMGGSPEGEAQFFYHNTSNYWRHGIVALDWEMDDNPAWGNWDWVRRFMAECERLSGGVRPLLYTGPVAGTIPQDIRDRYGLWIAQYANMSPTGYQANPWMIGAYGEAMRQYSGTGVVNTWSPIDLNIFRGEGWQWDLYANPTGSTAPAPATPAPVQPSTPPANTNTGGISHVMQWGETIWGLAVAYNAWPLSAWHTPSGDINRYYVGDVVTYGGGSTATPAPSVDYNALATAVIRGDYGNDPYRRQRLGGDYDKVMAIVNARLSGQAAPSYTAPNAPNYGRSYVVRANDTLSGIAARYGISYTLIHGYRSGNPALIYPGEVLYW

SEQ ID NO: 1337 - protein, 375 aa, Bifidobacterium breve
MADMNGIDVSGWQSPTVTCTADYDFAVVKATQGTGFTNGYMTSQARCVKQRGKSLGFYHYAGGGNATREADYFVNTVRPYVGEAVLVLDWESYQNAAWGNSNWIRVFVNRVHDRTGVWPLVYVSAAFIPQIPADVRANCGLWVAQYANNNPTGWQSRPWNYGKYGEAMRQYTSNGRINGYNGPLDLNYFRGTREQWDKYANPGKISKPAPTPAPQPAPSVDYEALATATIRGDYGNGESRRAALGANYGPVMRIVNQRLNGSAAYAPAASTRSVSVTVRSGDIMSGIAKRTGLWPLSAWSVPSGNINLIYPGNIVTYRGTATATRGSATTGGRVHVVKSGETLSGIFGANGWQRVAQLDNLANPNLIYPGQRLRY

SEQ ID NO: 1338 - protein, 267 aa, Bifidobacterium longum
MQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLTPI

SEQ ID NO: 1339 - protein, 274 aa, Bifidobacterium longum
MAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLTPI

SEQ ID NO: 1340 - protein, 163 aa, Bifidobacterium pseudocatenulatum
HDPVRPQVTATPDYDDMATKVIRGVYGNGNERRQALGGAYDTVMAIVNQRLGGSGVAPAAVNCGSVCVTVRSGDTLSTIAAHNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1341 - protein, 413 aa, Bifidobacterium pseudocatenulatum
MGILNNKGKPKHKRLRRHIGKPLTALAAVLCVAVAPVASANMNVIDVSGWQSADVTRVVDADAAIVKITEGFGYTNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVRHDPVRPQVTATPDYDDMATKVIRGVYGNGNERRQALGGAYDTVMAIVNQRLGGSAGTVSNTSNCGSVCVTVRSGDTLSTIAASNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1342 - protein, 415 aa, Bifidobacterium asteroides
MQSSHARHSRAKPGYGRIMVGMLAVLAMLAPGIANADAGFDNASYQGCYDAQTARDSGASFSITKITEGTGYVNPAADCQLAANRAAGLRLGAYAYARPEKGNSPEAEADFFNAQASARGLVHAGVIPFLDWEPPASHRGDTQWAKRWLDRVASHWGTKPIIYMSASTIHAGDWSAVAGADYGLWVAGYPRGYVGERLRDPGAPPYSVSPWPFAAAWQYSSTGHVPGVGTAVDVNWFYGDAATWAKYANAPVGTQANPVTPSPTPSQGAPVGDADSIATAVIRGEYGNDPQRRALLGNRYDEVMAVVNERLQGGSDGGGGSGVYVVRSGDCLSAVFGGSWPTIARLNGISPPYVIHPGQRLATGSGGGGGGRTVTVQRGDTLSGIAARLGIPQSRLHGYRSGNPSLIYAGETLRY

SEQ ID NO: 1343 - protein, 282 aa, Bifidobacterium longum
MQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGPVMRIVNQRLNGSAAYAPAASTRSVNVTVRSGDTMSGIAKRTGLWPVTAWSVPSGNINLIYPGNVVTYQGAATAASSGSAATGGRVHVVKSGETLSGIFGANGCQRVAQLNNLANPNLIYPGQRLRY

SEQ ID NO: 1344 - protein, 413 aa, unidentified
  REGION 1..413: note = Bifidobacterium
MGILNNKGKPKHKRLRRHIGKPLTALAAVLCVAVAPVASANMNVIDVSGWQSADVTRVVDADAAIVKITEGFGYTNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYDDMATKVIRGVYGNGNERRQALGGAYDTVMAIVNQRLGGSAGTVSNTSNCGSVCVTVRSGDTLSTIAASNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1345 - protein, 289 aa, Bifidobacterium longum
MAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGPVMRIVNQRLNGSAAYAPAASTRSVNVTVRSGDTMSGIAKRTGLWPVTAWSVPSGNINLIYPGNVVTYQGAATAASSGSAATGGRVHVVKSGETLSGIFGANGCQRVAQLNNLANPNLIYPGQRLRY

SEQ ID NO: 1346 - protein, 281 aa, Bifidobacterium longum
MQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLNNLANPNLIYPGQRLRY

SEQ ID NO: 1347 - protein, 267 aa, Bifidobacterium breve
MQESACLRHQFVGVVNVHERTGVWPLVYVSAAFIPQIPADVRANCGLWVAQYTNNNPTGWQSRPWNYGKYGEVMRQYTSNGRINGYNGPLDLNYFRGTREQWDKYANPGKSFKPTPMPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLTPI

SEQ ID NO: 1348 - protein, 413 aa, Bifidobacterium pseudocatenulatum
MGILNNKGKPQHKRLRRHVGKPLTALAAVLCVAVAPVASANMNVIDVSGWQSADVTRVVDADAAIVKITEGSGYTNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIAAGDRGKTHAEVRHDPVRPQVTATPDYDDMATKVIRGVYGNGNERRQALGGAYDTVMAIVNQRLGGSAGTVSNTSNCGSVCVTVRYGDTLSSIAASNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1349 - protein, 422 aa, unidentified
  REGION 1..422: note = uncultured Bifidobacterium sp.
MTMQGIDISSWQAGINLSVVPCDFAIVKATQGTNYTNPDCVRAVEQCLSLNKPFGVYHYVSGGNAVAEANFFVDSILNWVGKGILVVDWESNQNSAWGNTGYLDTLVKQIIKRTGVKPWIYASSAVFPWMVARNNDCGTWVAQYASMNATGYQDTPWNEGAYACTCRQYSSNGRLNGWNGGLDINKFYGDVNAWNAYAGNGATADPKPSAPSDPLAGYTDEQLADAVLRGEYGDDPQRKAALGSRYDAVQAIVNQRLGVAQSTNSGGIKYTVKSGDTLSAIASRFGVSVNDITGYSSGNPNLIYQGEVLTIGGGAKAPATTTKTYTVQSGDTLSGIAAKFGVSTSQISGYRSGNPNVIYPGEVLTIGGGSSAPAQTTRTYTVKAGDNLSTIAQRLGTTVNALVSRNGIANPNLIYPGQVLKY

SEQ ID NO: 1350 - protein, 448 aa, Bifidobacterium longum
MKQRGKSLGFYHYAGGGNATREADYFVNTVRPYVGEAVLVLDWESYQNAAWGNSNWIRVFVNRVHDRTGVWPLVYVSAAFIPQIPADVRANCGLWVAQYANNNPTGWQSRPWNYGKYGEAMRQYTSNGRINGYNGPLDLNYFRGTREQWDKYANPGKISKPAPTPAPQPAPSVDYEALATATIRGDYGNGESRRAALGANYGPVMRIVNQRLNGFAVYAPAASTRSVSVTVRRGDTMPGIAKRTGLWPLSAWSVPSGNISLIYPGNIVTYRDAVTSASSGSTTTGGHVYVVKSGETLSGIFGANGWQRVAQLNNLSNPNLIYPGQRLRYWPQPSWPSAPCRRPPSSSNQGEDYGYFHRDHTRIRARGLDRARIRAGVQEIHPQQIRRTYVPRSVHPVRHHRHRRHRRIRRHLHVGGIVLAGVVGVAQTVYTLVNQAFDGKLSKDSGTF

SEQ ID NO: 1351 - protein, 289 aa, Bifidobacterium longum
MAVGGDEMQESACLRHQFVGVVNVHERTGVWPLVYVSAAFILQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGPVMRIVNQRLNGSAAYAPAASTRSVNVTVRSGDTMSGIAKRTGLWPVTAWSVPSGNINLIYPGNVVTYQGAATAASSGSAATGGRVHVVKSGETLSGIFGANGCQRVAQLNNLANPNLIYPGQRLRY

SEQ ID NO: 1352 - protein, 288 aa, Bifidobacterium longum
MAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGWQRVAQLNNLANPNLIYPGQRLRY

SEQ ID NO: 1353 - protein, 208 aa, Bifidobacterium longum
MRQYTSNGRINGYNGPLDLNYFRGTREQWDKYANPGKATKPTPTPAPQPAPSVDYEALATATIRGDYGNGETRRAALGANYGPVMRIVNQRLNGSAAYAPAASTRSVSVTVRSGDTMSGIAKRTGLWPLNAWSVPSGNINLIYPGNIVTYRGTATAASGSAATGGRVHVVKSGETLSGIFGANGCQRVAQLNSLANPNLIYPGQRLRY

SEQ ID NO: 1354 - protein, 273 aa, unidentified
  REGION 1..273: note = Caudoviricetes sp.
MSKSNLTQIVVPADEGNYTKGRSGRSIEAITIHHMAGVLSAEQCGRIFQAKGRYGSSHYGVGYDGSIANYVDEEDTAWTNSNWDSNCKSVTIETSNSQAGGNWPVSDNALNSLIRLVADIANRRGLGTLIPGKNLTWHSMFTSTTCPGDYLRSKMQYIADEANKINSEEPIKKKTTEELAREVIEGKYGNGEDRKNALGDRYAEVQARVNEILATVLEPSVDIVDLVRKTIRGDFGNGEDRKSALGSNYDEVQRQVNLNFQNGTTNWDNVRLY

SEQ ID NO: 1355 - protein, 205 aa, Prevotella sp.
MVQLKKKVTIKTKIPQEETPAEVKPVVTQKPEEPNVNVPPETPPTKKSKNWIWIVLVLSAVVLFLCYKSCDKSPATESSNDQTTTTQVEGNNDSVVVDGNESEVTPSNETDDNADENVASESELKDEDTVDEKQATEPQTTTAPNNSVQQNNASSVSISGTLEEKAKAVIRGNYGNGLERKQKLGEEYAEIQGKVNEMYRNGLVK

SEQ ID NO: 1356 - protein, 199 aa, unidentified
  REGION 1..199: note = Phocaeicola vulgatus
MVQLKKKVTLKTKRADSDVKQDIQPKNTVPQEPVNKTGGGNKRNLWVFLGIVVLAAILFFVFVGKDNETSVKTNVAQNHVTAKADSIQPAKTEETAEKVDSTNVEKTDNTLKEEPTKATAEMPASESNSKQSSKPDVVKEEKKTQTSSAIPVNGSLEQKAIAVIRGTYGNGLERKQKLGDEYTVIQNKVNEMYRDGLVD

SEQ ID NO: 1357 - protein, 150 aa, Clostridium sp.
RGLGILVPGKNLTWHSMFTNTTCPGDYLRSKMQYIADEANKINNPEPIKEKTTEELAQEVIAGKYGNGEDRKNALGDRYAEVQARVNEILAPTQEPSVDILDLVRKTIRGDFGNGEDRKSALGSNYDEVQRQVNLNFQNGTTNWDNVRLY

SEQ ID NO: 1358 - protein, 271 aa, unidentified
  REGION 1..271: note = Bacilli bacterium
MSKSSLVQVVVPADEGNYTKGRSGRSIEAITIHHMAGRLTAEQCGRIFQAKGRYGSSHYGVGYDGSIANYVDEENTAWTNSNWDSNCKSITIEISDNDNSWYVNDTTLNAVIKLVADIAKRRGLGTLVSGKNLTWHSMFTNTTCPGDYLRSKMQYIADEANKINNSEPIKEKTTEELAREVIEGKYGNGEDRKNALGDRYAEVQARVNEILAPAPEPSVDILDLVRKTIRGDFGNGEDRKNALGSNYDEVQRQVNLNFQNGTTNWDSVKLY

SEQ ID NO: 1359 - protein, 199 aa, unidentified
  REGION 1..199: note = Bacteroidales
MVQLKKKVTLKTKIADSDVKQDIQPKNTAPQEPVNKTGGGKKRNLWVFLGIVVLAAILFFVFVGKDNETSVQTNVAQNPVTAKADSIQPAKTEETAEKVDSTNVEKTDNTLKEEPTKATAEMPSSESNSKQSSKPDVVKVEKKTQTSSAIPVNGSLEQKAIAVIRGTYGNGLERKQKLGDEYTVIQNKVNEMYRDGLVD

SEQ ID NO: 1360 - protein, 199 aa, unidentified
  REGION 1..199: note = Bacteroidales
MVQLKKKVTLKTKIADSDVKQDIQPKNTAPQEPVNKTGGGNKRNLWVFWGIVVLAAILFFVFVGKDNETSVQTNVAQNPVTAKADSIQPAKTEETAEKVDSTNVEKTDNTLKEETTKATAEMPSSESNSKQSSKPDVVKVEKKTQTSSAIPVNGSLEQKAIAVIRGTYGNGLERKQKLGDEYTVIQNKVNEMYRDGLVD

SEQ ID NO: 1361 - protein, 199 aa, unidentified
  REGION 1..199: note = Bacteroidales
MVQLKKKVTLKTKIADSDVKQDIQPKNTAPQEPVNKTGGGNKRNLWVFLGIVVLAAILFFVFVGKDNETSVQTNVAQNPVTAKADSIQPAKTEETAEKVDSTNVEKTDNTLKEESTKATAEMPSSESNSKQSSKPDVVKVEKKTQTSSAIPVNGSLEQKAIAVIRGTYGNGLERKQKLGDEYTVIQNKVNEMYRDGLVD

SEQ ID NO: 1362 - protein, 199 aa, Bacteroides ovatus
MVQLKKKVTLKTKRADSDVKQDIQSKNTAPQEPVNKTGGGNKRNLWVFLGIVVLAAILFFVFVGKDNETSVKTNVAQVPVTAKADSIQPAKTEETAEKVDSTNVEKTDNTLKEEPTKATAEMPSSESNSKQSSKPDVVKEEKKTQTSSAIPVNGSLEQKAIAVIRGTYGNGLERKQKLGDEYTVIQNKVNEMYRDGLVD

SEQ ID NO: 1363 - protein, 199 aa, unidentified
  REGION 1..199: note = Bacteroidaceae
MVQLKKKVTLKTKIADSDVKQDIQPKNTAPQEPVNKTGGGNKRNLWVFLGIVVLAAILFFVFVGKDNETSVQTNVAQNPVTAKADSIQPAKTEETAEKVDSTNVEKTDNSLNEEPAKATAEMPSSESNSKQSSKPDVVKEEKKTQTSSAIPVNGSLEQKAIAVIRGTYGNGLERKQKLGDEYTVIQNKVNEMYRDGLVD

SEQ ID NO: 1364 - protein, 199 aa, unidentified
  REGION 1..199: note = Bacteroidales
MVQLKKKVTLKTKIADSDVKQDIQPKNTAPQEPVNKTGGGNKRNLWVFLGIVVLAAILFFVFVGKDNETSVQTNVAQNPVTAKADSIQPAKTEETAEKVDSTNVEKTDNTLKEEPTKATAEMPSSESNSKQSSKPDVVKVEKKTQTSSAIPVNGSLEQKAIAVIRGTYGNGLERKQKLGDEYTVIQNKVNEMYRDGLVD

SEQ ID NO: 1365 - protein, 199 aa, Parabacteroides distasonis
MVQLKKKVTLKTKIADSDVKQDLQPKNTAPQEPINNTGGGNKRNLWIFLGIVVLAAILLFVFVGKGKESSVQTNVAQNHVTAKADSIQAAKTEEAAEKVDSTNVEKTDNTLKEEPAKATTEMPSSETNSKQGSKPDVVKEEKKTQTSSVQSINGSLEQKAIAVIRGTYGNGLERKQKLGDEYTVIQNKVNEMYREGLVD

SEQ ID NO: 1366 - protein, 198 aa, unidentified
  REGION 1..198: note = Phocaeicola vulgatus
MVQLKKKVTLKTKRTDSDVKQDIQPKNTVPQELVNKTGGGNKRNLWVFWGIVVLAAILFFVFVGKDNETSVQTNVAQNPVTAKADSIQPAKTEETAEKVDSTNVEKTDNTLNEEPTKATAEMPSSESNSKQSSKPDVVKEEKKNQTSAIPVNGSLEQKAIAVIRGTYGNGLERKQKLGDEYTVIQNKVNEMYRDGLVD

SEQ ID NO: 1367 - protein, 199 aa, unidentified
  REGION 1..199: note = Phocaeicola vulgatus
MVQLKKKVTLKTKRADSDVKQDIQSKNTAPQEPVNKTGGGNKRNLWVFLGIVVLAAILFFVFVGKDNETSVKTNVAQVPVTAKADSIQPAKTEETAEKVDSTNVEKTDNTLKEEPTKATAEMPSSESNSKQGSKPDVVKEEKKTQTSSAIPVNGSLEQKAIAVIRGTYGNGLERKQKLGDEYTVIQNKVNEMYRDGLVD

SEQ ID NO: 1368 - protein, 232 aa, unidentified
  REGION 1..232: note = uncultured Prevotella sp.
MNKSKKLFNSEDFDKKKPLFGPEDFDKSGNDSSSPHPVEKFRKAKIIGGIVAAAVIISGGIFFFINNKESEGGNDGTPTEVIAQNTENQNEGNDAPAAETSNEDVSAESKGVPANTSEAPAAENTDESPANTTSSANPAKANDNQVAERPAKRNPATIAEPVKPVQSKPAATQTTKPFSVTSAPVSGDVEENARRVIRGDFGNGQERRDKLGSSYSEIQGKVNEMYRQGIVN

SEQ ID NO: 1369 - protein, 199 aa, Parabacteroides distasonis
MVQLKKKVTLKTKIADSDVKQDIQPKNTAPQEPVNKTGGGNKRNLWVFLGIVVLAAILFFVFVGKDNETSVQTNVAQNPVTAKADSIQPAKTEETAEKVDSTNVEKTDNTLKEEPTKATAEMPSSESNSKQSSKPDVVKVEKNPQTSSAIPVNGSLEQKAIAVIRGTYGNGLERKQKLGDEYTVIQNKVNEMYRDGLVD

SEQ ID NO: 1370 - protein, 198 aa, unidentified
  REGION 1..198: note = Phocaeicola massiliensis
MVQLKKKVTLKTKRTDSDVKQDIQPKNTVPQELVNKTGGGNKRNLWVFWGIVVLAAILFFVFVDKDNETSVQTNVAQNPVTAKADSIQPAKTEETAEKVDSTNVEKTDNTLNEEPTKATAEMPSSESNSKQSSKPDVVKEEKKNQTSAIPVNGSLEQKAIAVIRGTYGNGLERKQKLGDEYTVIQNKVNEMYRDGLVD

SEQ ID NO: 1371 - protein, 271 aa, unidentified
  REGION 1..271: note = Bacteriophage sp.
MSKSSLTQIIVPADEGNYTKGRDGRSIEAITIHHMAGRLTAKQCGRIFQAKGRYGSSHYGVGYDGSIANYVDEEDTAWTNSNWDSNCKSVTIEISDNDNSWYVNDITLNAVIKLVADIAKRRSLGILVPGKNLTWHSMFTNTTCPGDYLRSKMQYIADEANKINSEEPIKEKTTEELAREVIEGKYGNGEDRKNALGDRYAEVQARVNEILAPVPEPSVDILDLVRKTIRGDFGNGEDRINALGSNYDEVQRQVNLNIQNGTTNWDNVRLY

SEQ ID NO: 1372 - protein, 253 aa, unidentified
  REGION 1..253: note = Leyella stercorea
MKTKVAQGETPEAIESPKVTLKRKLPEAPVVAEPKPAHAPTQPTAEPKQEPKPVSPTPQPEKKPNTGKVIGGLIAAAIIAGIFFFINNKESENGNDNTQTEAIAQNTENQDKGNNALAAENSNEYASAESKGVPANGSEVPVAENTDKSPANTTSSANPAKANDNQVAEQSTKQNPTIIAESAKPTLSKPAATQPTRSSSATSAPVSGDVEENARRVIRGDFGNGQERRDKLGSSYYEIQGKVNEMYRQGLVH

SEQ ID NO: 1373 - protein, 197 aa, unidentified
  REGION 1..197: note = Phocaeicola plebeius
MVQLKKKVTLKTKKVDSDIKQDIQSKGTASQEPVKNSNGGNKRNLWIFLGIIALVVILFFVFLGKNKGSKSQLPKDNGGTVVKIDSIKPTEDNTETTDSISVTKEDSALKKDSVNLTPEKSSNEDNSNNGSTTNVAKDELNPQNSSSEPLNGSLEQKAIAVIRGTYGNGLERKQKLGNEYTVIQNKVNEMYRDGLVD

SEQ ID NO: 1374 - protein, 269 aa, Anaerococcus sp.
MSNSPLVQATILSPNHSGRRNQRISKIAIHHAAGVISGKNLARIFEPRSRQASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNKTVSKPTGGLYRVRKSWSDVKSQKGAFKNLDNAKRCADRFGLKVFEANGKIVYPVGKTIDQLAREVISGKWGNGEERKRRLTQAGYDYYAVQKRVNQII

SEQ ID NO: 1375 - protein, 269 aa, unidentified
  REGION 1..269: note = Tissierellia bacterium
MSNSPLVQARILSPNHSGRRNQKITKIAIHHAAGVINGRNLAGVFVPKSRRASANYNLGSDGVIVLGVDESNRAWTTSSSWCDNRAVTIEVGNSTKGPQWLISDYVLNRLIDLVTDICRRNGIYPCTYTGGKDGVLQKHEWYKNTNCPGPYLGSKFPYIANEVNKRLRGDKTVSKPTGGLYRVRKSWSDVKSQKGAFKNLDNAKRCADRFGLKVFDVNGEIVYPVGKTIDELAKEVIRGDWGNGEERKRKLTNAGYDYKAVQKRVNQLV

SEQ ID NO: 1376 - protein, 269 aa, Finegoldia magna
MSNSPLVQATILSPNHSGRRNQKITKIAIHHAAGVINGKNLAGVFVPRARRASANYNLGSDGVIILGVDERNRAWTTSSPWCDNRAVTIEVGNSTRGPQWLVSDYVLNRLIDLVTDICRRNGIYPCTYTGGKDGVLQKHEWYSNTNCPGPYLGSKFPYIANEVNKRLRGNKTVSKPTGGLYRVRKSWPDVKSQKGAFKNLENAKRCADRFRLKVFDANGKIVYPVGKTIDQLAREVINGKWGNGEDRKRRLSSAGYDYYAVQRRVNQLI

SEQ ID NO: 1377 - protein, 269 aa, Peptoniphilus harei
MSNSPLVQARILSPNHSGRRNQRITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNKTVSKSIGGLYRVRKSWSDVKSQKGAFKNLDNAKRCADRFRLKVFDANGKIVYPFGKTIDELAKEVISGKWGNGEERKRRLTQAGYDYYAVQKRVNKLI

SEQ ID NO: 1378 - protein, 269 aa, Anaerococcus sp.
MSNSPLVQATIRSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNNTVSKPTSGLYRVRKSWSDVNSQKGAFKNIDNAKRCADRFGLKVFDANGNIIYPTDKTIDQLAREVISGKWGNGEERKRRLTQAGYDYYAVQKRVNQLV

SEQ ID NO: 1379 - protein, 68 aa, Finegoldia magna
NAKRCADRFGLKVFDANGKIVYPVGKTIDQLAREVISGKWGNGEERKRRLTNAGYDYYAIQRRVNQII

SEQ ID NO: 1380 - protein, 309 aa, unidentified
  REGION 1..309: note = Acutalibacteraceae bacterium
MTDREKFLEAAKTYIGKNGKFVCLEKLKIGFICDWCAFSVSAIMNDCGFIGKYIKAIEGGAGTIPRYSDGKYGEWFKKGTKSPQAGDLFFLRYNDYPYQDKYFCDHIGIVEEANGNIITTLEGNVDGISGNWAATSTFKRKVRYLNNATVYAFYRPNWKETEPDTSSNQANVKTPVKQTASYNGVMNVTSASKVNFTAQVTASDGVNLRIGPSVNFTKVGAVPYGEKLKITRQTSGGGYFWGLTEYKGTAGWVALNFTQKVHDKTIDELAAEVIRGEWSAGPERERLLHQAGYDYQAVQKRVNELMNSM

SEQ ID NO: 1381 - protein, 105 aa, Butyrivibrio sp.
IRAYPNFGDNIKGQTGRGTFTIVEVRNGWGRLKNGIGWIWLEEEAYCTILDHIVADSYEKKSIDEVAMEVINGKWGNGEERKRRLTEAGYDYYAVQKRVNELIWY

SEQ ID NO: 1382 - protein, 269 aa, unidentified
  REGION 1..269: note = Anaerococcus obesiensis
MSNSPLVQARILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDSVLQKHEWYKSTNCPGPYLGSKFPYIASEVNKRLRGDKTVSKPTSGLYRVRKSWSDVRSQKGAFKNLDNARRCADRFGLKVFDANGKIVYPVGKTIDELAREVIRGKWGNGEERKRRLTDAGYDYYVIQKRVNELI

SEQ ID NO: 1383 - protein, 269 aa, unidentified
  REGION 1..269: note = Peptoniphilus obesi
MSNSPLVQARILSPNHSGRRNQKITKIAIHHAAGVINGRNLAGVFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIANEVNKRLRGNNTISKPTGGLYRVRKSWSDPKSQKGAFKNLENAKRCADRFGLKVFDANGKIVYPVGKTIDQLAREVISGKWGNGEERKRRLTNAGYDYYAIQRRVNQLI

SEQ ID NO: 1384 - protein, 269 aa, unidentified
  REGION 1..269: note = Anaerococcus provencensis
MSNSPLVQATILSPNHSGRRNQKITKIAIHHAAGVINGRNLAGVFVPRSRKASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFSYIASEVNKRLRSDKTVSKKAGELYRVRKSWSDAKSQKGAFRNIENAKKCADRFGLKVFDANGKIIYPVGKTIEELAKEVISGKWGNGEERKRRLTNAGYDYKAVQRRVNQLI

SEQ ID NO: 1385 - protein, 269 aa, unidentified
  REGION 1..269: note = Anaerococcus jeddahensis
MSNSLLVQATILSPNHSGRRNQKITKIAIHHAAGVINGRNLAGVFVPRSRRASANYNLGSDGVIVLGVDEANRAWTTSSSWCDNRAVTIEVGNSTRGPQWLVSDYVLNRLIDLATDICRRNGIYPCTYTGGKDGVLQKHEWYKNTNCPGPYLGSKFPYIASEVNKRLRGDKTVSKPTSALYRVRKSWSDIKSQKGAFKNLENAKRCADRFGLKVFDANGKIVYPVGKTIDQLAREVISGKWGNGEERKRRLTQAGYDYKEVQRRVNQLV

SEQ ID NO: 1386 - protein, 269 aa, unidentified
  REGION 1..269: note = Peptoniphilaceae
MSNSPLVQARILSPNHSGRRNQRITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNKTVSKSIGGLYRVRKSWSDVKSQKGAFKNLDNAKRCADRFRLKVFDANGKIVYPVGKSIDDLAREVISGKWGNGEERKRRLTQAGYDYYAIQRRVNQLV

SEQ ID NO: 1387 - protein, 269 aa, unidentified
  REGION 1..269: note = Peptoniphilus sp. HMSC075B08
MSNSPLVQARILSPNHSGRRNQKITKIAIHHAAGVINGRNLAGVFVPRSRRASANYNLGSDGVIVLGVDEANRAWTTSSSWCDNRAVTIEVGNSTRGPQWLVSDYVLNRLIDLATDICRRNGIYPCTYTGGKDGVLQKHEWYKNTNCPGPYLGSKFPYIASEVNKRLRGDKTVSKPTSALYRVRKSWSDIKSQKGAFKNLENAKRCADRFGLKVFDANGKIVYPVGKTIDQLAREVISGKWGNGEERKRRLTQAGYDYKEVQRRVNQLV

SEQ ID NO: 1388 - protein, 269 aa, unidentified
  REGION 1..269: note = Peptoniphilaceae
MSNSPLVQARILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIAREVNKRLRGNNTIGKPTGGLYRVRKSWSDVKSQKGAFKNLENAKRCAYRFRLKVFDANGKIVYPVGKSIDDLAREVISGKWGNGEERKRRLTQAGYDYYAIQRRVNQLV

SEQ ID NO: 1389 - protein, 274 aa, unidentified
  REGION 1..274: note = Peptoniphilus vaginalis
MSNSPLVQARILSPNHSGRRNQKITKIAIHHAAGVINGRNLAGVFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIANEVNKRLRCNKTVSKPTGGLYRVRKSWSDVKSQKGAFKNLENAKKCVNANPGYAVYDANGRSLYPVASAPSKSVDTLAREVIAGNWGNGEERKRRLTNAGYDYYAIQRRVNELI

SEQ ID NO: 1390 - protein, 270 aa, unidentified
  REGION 1..270: note = Anaerococcus faecalis
MSNSKLVNMVNYSPNHSGRRNQPITKIAIHHTAGAINAAVIGEIFKPRSRRASCNYGIGKDNKVILCVDESHRSWCTSSSWCDNRAVTIEVANSSNGGNWPVSDEVLETLIKLVTDICRRNGIKNCTYTGGKDGVLQKHEWYSNTNCPGPYLGSKFPYIASEVNKRLRGNNSISKSTNNLYRVRKSWSDAKSQKGAFRNLDNAKRCADRFGLKVFDANGKIVYPVGKTIDQLAREVIRGDWGNGEERKRRLTNAGYDYYAVQKIVNQLIL

SEQ ID NO: 1391 - protein, 269 aa, unidentified
  REGION 1..269: note = Anaerococcus faecalis
MSNSPLVQARILSPNHSGRRDQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIANEVNKRLRGNNTVSKPTNGLYRVRKSWPDSKSQKGAFKNLDNAKRCADRFGLKVFDVNGKIVYPIGKTIDQLAREVISGKWGNGEERKRRLTQAGYDYKAVQKRVNQLI

SEQ ID NO: 1392 - protein, 269 aa, Peptoniphilus harei
MSNSPLVQATILSPNHSGRRNQKITKIAIHHAAGVISGRNLARIFIPESRQASANYNLGSDGVIVLGVDESNRAWTSSSSWCDNRAVTIEVGNSTRGPQWLVSDYVLNRLIDLVTDICRRNGIYPCTYTGGKDGVLQKHEWYKNTNCPGPYLGSKFPYIASEVNKRLRSDKTVSKPTSGLYRVRRSFSDVKSQKGAFKNLDNAKRCADKFGLKVFDANGKIVYPFGKTIDELAKEVISGKWGNGEERKRRLTQAGYDYYAVQKRVNKLI

SEQ ID NO: 1393 - protein, 318 aa, unidentified
  REGION 1..318: note = Butyrivibrio sp. LB2008
MNLVESILTENPCYKEGRKITVKGLMLHSVGVAQPNAMVFVRSWNTAAHDNSCVHAFIDANDGTIYQTLPWDHRGWHAGGSANNTHIGIEMCEPASLKYVSGAQFTCSDRDGAVIQVERTYNAAVELFAMLCKEYGLDPMEDGVIVSHNEGHSRGIASNHSDPEHLWTQLSTGYTMNSFRRAVKELMDKEVSNANDNYPPTPFSVKVLIDNLNIRAYPNFGDNIKGQTGRGTFTIVEVRNGWGRLKNGIGWIWLEEEAYCTILDHIVADSYEKKSIDEVAMEVINGKWGNGEERKRRLTEAGYDYYAVQKRVNELIWY

SEQ ID NO: 1394 - protein, 269 aa, unidentified
  REGION 1..269: note = Anaerococcus sp. NML200537
MSNSPLVQARILSPNHSGRRNQKITKIAIHHAAGVINGRNLAGVFVPRSRRASANYNLGSDGVIVLGVDESNRAWTTSSSWCDNRAVTIEVGNSTRGPKWLVSDYVLNRLIDLVTDICRRNGIYPCTYTGGKDGVLQKHEWYKSTNCPGPYLGSKFPYIANEVNKRLRGNNTISKPTGGLYRVRKSWSDVKSQKGAFKNLDNAKRCADRFRLKVFDANGKIVYPVGKSIDDLAREVISGKWGNGEERKRRLTQAGYDYYAIQRRVNQLV

SEQ ID NO: 1395 - protein, 269 aa, unidentified
  REGION 1..269: note = Peptoniphilus rhinitidis
MSNSPLVQATILSPNHSGRRNQKITKIAIHHTAGVINGRNLAGVFVPRSRRASANYNLGSDGVIVLGVDESNRAWTTSSSWCDNRAVTIEVGNSTRGPQWLVSDYVLKRLIDLVTDICRRNGIYPCTYTGGKDGVLQKHEWYKSTNCPGPYLGSKFPYIASEVNKRLRGNNTVSKPTSGLYRVRKSWSDSKSQKGAFKNLENAKRCADRFGLKVFDANGKIVYPVGKTIEELAKEVISGKWGNGEERKRRLTNAGYDYRAVQRRVNQLI

SEQ ID NO: 1396 - protein, 269 aa, Finegoldia magna
MSNSPLVQATILSPNHSGRRNQKITKIAIHHAAGVISGRNLAGVFVPKSRRASANYNLGSDGVIVLGVDESNRAWTTSSGWCDNRAVTIEVGNSTRGPQWLVSDYVLNRLIDLVTDICRRNGIYPCTYTGGKGGVLQKHEWYSNTNCPGPYLGSKFPYIANEVNKRLRCNKTVSRPAGGLYRVRKSWSDVKSQKGAFKNLDNAKRCADRFGLKVFDANGKIVYPVGKTIDQLAREVISGKWGNGEERKRRLTNAGYDYYAIQRRVNKLI

SEQ ID NO: 1397 - protein, 269 aa, Peptoniphilus harei
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPHIASEVNKRLRSNKTVSKPTSGLYRFRKSWSDVKSQKGAFKNLENAKRCADRFGLKVFDSNGKIVYPVGKTIDQLAKEVISGKWGNGEERKRRLTQAGYDYYAVQKRVNQLI

SEQ ID NO: 1398 - protein, 269 aa, Peptostreptococcus anaerobius
MSNSSLVQATILSPNHSGRRNQKITKIAIHHAAGVINGRNLARVFAPRSRRASANYNLGSDGVIVLGVDESNRAWTTSSSWCDNRAVTIEVGNSTRGPQWQVSDYVLNRLIDLVTDICRRNGIYPCTYTGGKDGVLQKHEWYKNTNCPGPYLGSKFPYIANEVNKKLRGDKTVSKPVGGLYRVRKSWSDHKSQKGAFKNLENAKRCADRFGLKVFDVNGKIVYPVGKTIDELAKEVISGKWGNGEERKRRLTQAGYDYYAVQKRVNKLV

SEQ ID NO: 1399 - protein, 269 aa, unidentified
  REGION 1..269: note = uncultured Anaerococcus sp.
MSNSPLVQAAILSPNHSGRRNQKITKIAIHHAAGVINGRNLAGIFVPRSRRASANYNLGSDGVIVLGVDESNRAWTTSSSWCDNQAVTIEVGNSTRGPQWLVSGYVLNRLIDLVTDICKRNGIYPCTYTGGKDGVLQKHEWYKNTNCPGPYLGSKFPYIANEVNKRLRGNNTVSKPTSGLYRVRKSWSEAKSQKGAFKNLDNAKRCADRFGLKVFDVNGKIVYPVGKTIEELAKEVISGKWGNGEERKRRLTNAGYDYKAVQKRVNELI

SEQ ID NO: 1400 - protein, 269 aa, unidentified
  REGION 1..269: note = Peptoniphilaceae
MSNSPLVQATILSPNHSGRRNQKITKIAIHHAAGVINGKNLAGVFIPRSRQASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIANEVNKRLKGNKTVSRPVGGLYRVRKSWSDVKSQKGAFKNLDNAKRCADRFGLKVFDANGKIVYPVGKTIDQLAREVISGKWGNGEERKRRLTNAGYDYYAIQRRVNQII

SEQ ID NO: 1401 - protein, 269 aa, unidentified
  REGION 1..269: note = Peptoniphilus lacydonensis
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSNTNCPGPYLGSKFPYIAREVNKRLRGNNTISKPTGGLYRVRKSWSDINSQKGAFKNLENAKRCADRFGLKVFDANGKIVYPVGKTIDQLAREVISGKWGNGEERKRRLTQAGYDYYAIQRRVNKLI

SEQ ID NO: 1402 - protein, 269 aa, Anaerococcus vaginalis
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIANEVNKRLRGNNTVSKPTSGLYRVRKSWSDPKSQKGAFKNLENAKRCADRFGLKVFDANGNIIYPTDKTIDQLAREVISGKWGNGEERKRRLTQAGYDYYAVQKRVNQLV

SEQ ID NO: 1403 - protein, 269 aa, Anaerococcus vaginalis
MSNSPLVQARILSPNHSGRRNQKITKIAIHHAAGVINGRNLAGIFVPRSRKASANYNLGSDGVIVLGVDESNRAWTTSSSWCDNRAVTIEVGNSTRGPQWLVSDYVLNRLIDLVTDICKRNCIYPCTYTGGKDGVLQKHEWYKNTNCPGPYLGSKFPYIASEVNKKLRGDKTVGKSVGGLYRVRKSWNDFKSQKGAFKNLENAKRCADRFGLKVFDANGKIVYSVGKTIDQLAREVIRGDWGNGEERKKRLTQAGYDYRAVQKIVNELI

SEQ ID NO: 1404 - protein, 270 aa, Finegoldia magna
MSNSPLVQARILSPNHSGRRNQRITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIANEVNKRLRGNNTVSKPTSGLYRVRKSWSDVKSQKGAFKNLENAKRCADRFGLKVFDANGKIVYPVGKTIDHLAREVISGKWGNGEERKRRLTQAGYDYYAVQKRVNKLIK

SEQ ID NO: 1405 - protein, 269 aa, unidentified
  REGION 1..269: note = Peptoniphilus lacydonensis
MSNSPLVQATILSPNHSGRRNQMITKIAIHHAAGVINGRNLAGIFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFLYIASEVNKRLRGDKTVSKPTSGLYRVRKSWDDPKSQKGAFKNLENTKRCADRFGLKAFDANGKIVYPVGKTIDELAKEVISGKWGNGEERKRRLTNAGYDYKEVQKRVNELI

SEQ ID NO: 1406 - protein, 271 aa, unidentified
  REGION 1..271: note = Anaerococcus porci
MSNSKLVNMVNYSPNHSGRRNQPITKIAIHHTAGAINAAVIGEIFKPRSRRASCNYGIGKDNKVILCVDESHRSWCTSSSWCDNRAVTIEVANSSNGGNWPVSDEVLETLIKLVTDICRRNGIKNCTYTGGKDGVLQKHEWYSNTNCPGPYLGSKFPYIASEVNKRLRGNNSISKSTNNLYRVRKSWSDAKSQKGAFRNLDNAKRCADRFGLKVFDANGKIVYYPVGKTIDQLAREVIRGDWGNGEERKRRLTNAGYDYYAVQKIVNQLIL

SEQ ID NO: 1407 - protein, 223 aa, Anaerococcus vaginalis
FRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIASEVNKRLRGNNTVSKPTSGLYRVRKSWSDSKSQKGAFKNIDNAKRCADRFGLKVFDVNGEIVYPIGKTIDQLAREVISGKWGNGEERKRRLTQSGYDYYAVQKRVNKLI

SEQ ID NO: 1408 - protein, 224 aa, unidentified
  REGION 1..224: note = Bacteroidota bacterium
MALDLNKSNDGATPSSGKQGGGLNLKKSDDASGSKFNLSKGETGTATGGDSSTNSDSDSSKGKGPWMWVLLIIAVLGVGVYFFAGSSSNSGGDTSGVATTETTGQAADAIGTTTGDSSNQMPSPSDGNTALPSAGDNTSGIEAQGPGSTASQTGNTAVVDSPAPVTGIVTDDKNTNPPQLEGTLEEKARLVIKGAFGNGAERRSALGSQYDEIQAKVNELLSSN

SEQ ID NO: 1409 - protein, 232 aa, unidentified
  REGION 1..232: note = Bifidobacterium moukalabense
MRKIISSLIAIVFAVSLTACGTTHQSTTNPVPSASHSKVSKPRKVSKPTVQTEQTVQAEEPEPQQPATDYNALAARVIAGEFGDGDARRAALGSDYDQVQAIVNSLMSQPVQSAPVQQPVQSAPQTVQQSVEQPTPVEVTQPEPSEVAQPVEPADAPDDVVAEFSANPSQSWDDWRTEFGSDADVDVPLSQVPVCAALDGSTGTGYEKVCQATSSDGLHYVLVGGTAMEVWR

SEQ ID NO: 1410 - protein, 243 aa, unidentified
  REGION 1..243: note = Bacteroidaceae bacterium
MVSIKHKVTIKTKTTQEETPAAVESPAVTLKRKQPEVTNEPTKVAAPAPEPDNKSNTGKIIGGVAAAAAILAGVYFFGIKGGDKTGDNVNPPTEQVAQTEDVTPPEATSPTDVPEEGTTEDEGTVSDTPENVSPTEASETPAKTGKEQSQTPAQPENKNADKPSSVASSATEPVQQSQSPKNNAATTPIEAASAPLSGDVVENAIRVIRGDFGNGQERKDKLGSAYAEIQAKVNEMYRNGQVN

SEQ ID NO: 1411 - protein, 286 aa, unidentified
  REGION 1..286: note = Siphoviridae sp. ctMAv2
MAYTNSKLVSYTKLSPNHSGHRTHSIDRITPHCVVGQCSVETLGNIFAPTSRQASCNYGIGPDGRVGMYVEEKNRSWCSSSNANDQRAVTIECASDTKHPYTMNSTVYAALIKLCVDICKRNGKKKLIWLGDKNKTLNYSPKSDEMVLTVHRWFANKSCPGDWLYSRLGDLASKVTAQLGGSSSGGTAASGLYRVRKSWNDAKSQKGAFKSLDNAKRCAASNPGYFVFDENGRIVGSTTSSTKTVDELAREVIRGNWGNGAERKNRLTAAGYDYNAVQKRVNELLK

SEQ ID NO: 1412 - protein, 344 aa, unidentified
  REGION 1..344: note = Caudoviricetes sp.
MCIVHSSNITPITQFLWVFLMAQKLHKCSRKHYGTEYGKKAIQQLFKEVNIMKNLWYLSPSDQTDNTGINGYGTEEAQMNALLDVITPHLDRCGVRYHRASRDLGIDYRPAESDRLGADYYLALHSNAGGGGAAYGPIAFYYAAGKELAEELVAQLRATGQKSNRYQSVIQNQNLYETRMMKAASCLLEVDFHDSAEGVNFIVGRRADAARAIAKAICKIDGTAWVEESATPAEPETPDMPPEAPSETVYVVKYGDTLSGIAREYGTTYQALAAYNGIANPNLIHVGDKIRIPGTAEAPVKSIEDLAREVIRGEWGNGQERVDRLTAAGYDYDAIQARVNTLLG

SEQ ID NO: 1413 - protein, 351 aa, unidentified
  REGION 1..351: note = Caudoviricetes sp.
MNNSSLVSHTKLSPNCDHPRNHAIDKITIHHMAGDLSVETCGNLFANPNREASANYGIGSDGRVGLYVDEGDRAWASASPSNDNRAVNIEVANDATGGDWPVSDAAYRKLIDLCVDICQRNGIKALNYTGGADGNLTEHRMFTATACPGPYLHERMGRIAAEVNNRLNKTSHPSEIVTQVAWEVIRGEWGNGSDRRQRLETAGYDYDAVQDRVNELLNSKEEPEQPGKPTTLDVHVGEIVDFKGGKHYTSANATSGTVVKASKAKVTAKSSGKHPIHLRAVNDKGTYISGVYGWVDLSTITTGSVVKKSVNEIALEVIAGKWGNGAERRCKLESAGYDYAAVQKRVNELPL

SEQ ID NO: 1414 - protein, 289 aa, unidentified
  REGION 1..289: note = Caudoviricetes sp.
MKIKGVDLSYCQEGISFPALKQAGVKFAIIRAGFSTKKDVTMDKFVADCKKHSIDYGFYWYSYAMSIEQAQTEAEKCISVIKGLSPTYPVFFDMEEKKQISGLNTDTRTKMAIAFCEKIRQAGFKPGVYANPSFMENYYDKSRIVGRYDIWLAHWTESPDKPSKYDYGQTLWQWGLDRIGGYDVDGDICFFDYAKSAPEKKTVDELADEVIAGKWDNGAERERLLTTAGYDYNAVQKRVNEKLYKKTVYEIAVEVIAGLWGNGSERKEKLTEAGYDYLEVQKKVNQMIK

SEQ ID NO: 1415 - protein, 535 aa, unidentified
  REGION 1..535: note = Caudoviricetes sp.
MMTNIELVNKLKDIAKNYKTLYVMGCFGAPMTASNKKRYTQNHEYNRRPERTAMINAASADTFGFDCCCLIKGVLWGWHGDRNAVYGGATYASNGVPDYGADTMITVCKNVSTDFSKIEVGEAVWMEGHIGVYVGDGLAVECTPRWDNKVQITACNRSVSGYNRRNWTKHGKLPYVKYESVPETPSDPVTTTVKGIDVSKWQGEIDWAKVKAAGVKFAMIRLGYGSADGSACGLDGWFERNVQRAVKAGVDVGCYFYSYATSVAAAKKEAAYVVSVLQKYKGVFSYPVAFDLEDKTQQNLGKTVLTDMVIAFGDAIEKAGFYCSLYSNLDWLKNRLDDSKLKRFDHWLAQWASAPTYDGAFGMWQNSSKGSVNGISGNVDTDVAYKDYPAVIRGAKLNGFTSSDQKPSVPAQPEEPAPQPSASFRKGDLVKITGTKYYSGKTIPAWVKAKNWYVLQADGARVVIDRSEDGRNAICSPVNAADLQLVTAVPQKTVDELAREVICGLWGNGADRRNRLTAAGYDYDAVQKRVNELLK

SEQ ID NO: 1416 - protein, 288 aa, unidentified
  REGION 1..288: note = Caudoviricetes sp.
MPKVYLSPSNQTENRYAYGNTNEAEQCGRIAEASRKALERSGVQVKVGHMPSMQEKVRESDAFGAELHVPIHTNAFNGSIMGTRMFCYNGAGRGMAACKAIFARVAPLSPGTSENIQVNPKPYEVRVPKAPTAYLECEFHDTVEGARWIVENAAAIGEAIARGICDYFGVTFKVPEQAAPVKSVDEVAREVIRGEWGNGSERRQRLEAAGYDFDAVQDRVNAILTGDEPEQPAEPAPAEPTEPATEPEQPATDKLYRVQVGAFAIRANAEKMVQRLKKAGFDGFIRHE

SEQ ID NO: 1417 - protein, 306 aa, unidentified
  REGION 1..306: note = Caudoviricetes sp.
MSKSGIDVSVWQGDIDFNAVKASGVEFVIIRAGYGIGHKDKWFEENYRKAKTAGLDVGAYWYSYASSAGEASEEAQSCVNILSGKSFEYPVYFDLEEKSQLNRGRAFCDSLITSFCNKLEACGYYAGFYTSLSTANNLVSAHVRNRYALWIAQWNTHCSYQGSYGLWQYSSSGSVPGVAGRVDMDYAYVDYPSIIKNVGLNGYQNGGSYTAPQASSIDEVAREVINGDWGNGNERKNRLTQAGYDYASVQNKVNGLLGVKAYRKSVDELAREVIRGNWGNGSMRKQRLTQAGYDYDAVQKRVNELL

SEQ ID NO: 1418 - protein, 282 aa, unidentified
  REGION 1..282: note = Caudoviricetes sp.
MSKVYLSPSNQTDNRYAYGNTTEAEQCGNIAYACRLALERSGIYVQMGHMASMQEKVAESNAFGADLHVPIHTNAFNGQVTGTRMFCYSEGGEGMKACKAIFARLAPITPGTSESIRVDASLYEVRVPAAPTAYVECEFHDNPEAAKWIVEHTENIGEAIAQGICDYFGVTFKAPEQPKPAESVDEVAREVIRGEWGNGSDRRQRLEAAGYDFDAVQERVNELLNSKEEPQHPADPTPAEPEQPATDKLYRVQVGAFANHENAERMLQRLKAAGFEGYIREE

SEQ ID NO: 1419 - protein, 358 aa, unidentified
  REGION 1..358: note = Caudoviricetes sp.
MAKVFLSPSNQYDNRYAYGNTTEGVQCGKIAEACKAALERSGVTVKLMHDESMQDKCKESNAFGADLHVPIHTNAFNGTVSGTRMFCFNSSGEGMKACKAIFNRLAPVTPGTSENIRVDASLYEVRVPSAPTAYIECEFHDNATTAKWIVEHTVDIGEAIARGICNYFGVTFKAPEQPAPAKSVDEVAREVIRGEWGNGSDRRQRLEAAGYDYGAVQDRVNELLNSKEETEQPGKPATLDVNVGEIVDFKGGKHYTSANATSGTEVKASKAKVTAKSSGKHPIHLRAVNDKGAYISGVYGWVDLSTITTGSVVKKSVNEIAREVIAGKWGNGAERRCKLESAGYDYAAVQKRVNELLI

SEQ ID NO: 1420 - protein, 328 aa, unidentified
  REGION 1..328: note = Bacteriophage sp.
MSNSSLVNMTMLSPNHSGHRNQPITKIAIHHTAGAISAATIGQIFRPTSRQASCNYGIGNDNKIVLCVDEANRSWCTSSSWCDNRAVTIEVANSANGGNWPVSDRTLATLIDLVTDICRRNGIRNCTYTGGKDGVLQKHEWYANTNCPGPYLGSKFSYIASEVNKRLSGNSSSSGGASTSSLYRVRKSWSDAKSQKGAFRDFDNAKKCANANEGYKVFDASGNEVYPNKVTLSKSVDTLAHEVLAGNWGNGSDRVNRLRAAGYDYDAVQNRVNEILSGTNSNPNRKSIDILAREVIRGDWGNGQDRVNRLTSAGYDYNAVQKRVNEIL

SEQ ID NO: 1421 - protein, 320 aa, unidentified
  REGION 1..320: note = Caudoviricetes sp.
MTMLSPNHSGHRNQSITKIAIHHTAGAVSAATIGQIFRPTSRQASCNYGIGNDNKIVLCVDEANRSWCTSSSWCDNRAVTIEVANSANGGNWPVSDRTLATLIDLVTDICRRNGIRNCTYTGGKDGVLQKHEWYANTNCPGPYLGGKFSYIASEVNKRLSGNSSSSGGTSTSSLYRVRKSWSDSKSQKGAFRDFDNAKKCANANVGYKVFDASGNEVYPDKSTSSKSIDTIAREVISGNWGNGSDRVNRLRAAGYDYDAVQSRVNEILSGTNSKPSGKSIDEVAREVIRGDWGNGQDRKNRLERAGYDYNAVQRRVNELL

SEQ ID NO: 1422 - protein, 306 aa, unidentified
  REGION 1..306: note = Caudoviricetes sp.
MSKKGIDVSVWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRDFCDSLITSFCNKLEACGYYAGFYTSLSVANNLVSSRVRDRYALWIAQWNTHCDYQGSYGLWQYSSSGSVGGIAGRVDMDYAYVDYPSVIKNAGLNGYKNGGSYTAPQASSIDEVAREVINGDWGNGNERKNRLTQAGYDYTSVQNKVNELFGVKAYRKSVDELAREVIRGTWGNGSTRKQRLTQAGYDYDAVQKRVNELL

SEQ ID NO: 1423 - protein, 328 aa, unidentified
  REGION 1..328: note = Caudoviricetes sp.
MSNSSLVNMTMLSPNHSGHRNQPITKIAIHHTAGAISAATIGQIFRPTSRQASCNYGIGNDNKIVLCVDEANRSWCTSSSWCDNRAVTIEVANSANGGNWPVSDRTLATLIDLVTDICRRNGIKNCTYTGGKDGVLQKHEWYANTNCPGPYLGSKFSYIASEVNKRLSGNSSSSGGASTSSLYRVRKSWSDVKSQKGAFRDFDNAKKCANANAGYKVFDASGNEVYPDKSTSSKSIDTIAREVISGNWGNGSDRVNRLRAAGYDYDAVQSRVNEILSGTNSKPSGKSIDEVAREVIRGDWGNGQDRKNRLERAGYDYNAVQRRVNELL

SEQ ID NO: 1424 - protein, 287 aa, unidentified
  REGION 1..287: note = Caudoviricetes sp.
MVEKINETLMSDSGRLVNLEFVVIHNDAGSMTPKQYIDWLRYRDKALGIAHYYCNRECIARVVDTFNIGYHTGDWWSNCRSIGYEVCESMKVSDTEFLQNEDVTLMQATEDLLFYGLPITTQTVRLHHEFVPTTCPHRSMELHGGSTESVKNYFVDRMNYFATLGSTVEEMMGQYNGEVTVEKVTSKENTLKSDETVANEVLQGLWGNGNERIELLTDAGYDAQKIQNIVNRLVLGEDDEDIVNIDEVAQEVIQGEWGNGDERKVRLENAGYNYQVVQDRVNELLGE

SEQ ID NO: 1425 - protein, 279 aa, unidentified
  REGION 1..279: note = Caudoviricetes sp.
MAMSNSGLVSYTKLSPNCDHPRNHAIDKITIHHMAGDLSVETCGNLFANPNREASANYGIGSDGRVGLYVDEGDRAWASASPSNDNRAVNIEVANDATGGDWPVSNAAYSKLIDLCVDICQRNGIKALNYTGDADGNLTEHRMFLATACPGPYLHERMGRIAAEVNSRLNKTPHPSEIVTQVAWEVIRGEWGNGSDRRQRLEAAGYDYDAVQDRVNELLNSKEETEQPTPAEPVEPAPAEPVPAVIYRVQVGAFANRENAEKMLQRLKDAGFEGYIREV

SEQ ID NO: 1426 - protein, 309 aa, unidentified
  REGION 1..309: note = Caudoviricetes sp.
MDRIFGIDVSDWQGDIDWEKVKAAGVKFALLKCGYGMDLTDQDDDCFVQNASECERLGIPYGVYLYSYANTMEKAKSEAAHVLRMLKGRKPQYPVYLDLEDQITLSVSKDQILAQVKAWCEIIEGAGYKAGIYANLYWWDTYLTDTWYDTKERWVAQYYTKCEYAKDYGIWQYTSRGSVDGVNGNVDCDWCYVDYLATEPEVPDMPPEAPSETVYVVKYGDTLSGIANEYGTTYQVLAAYNGIANPNLIHVGDKIRIPGTGEAPVKSIEDLAREVIRGEWGNGAERVDRLTAAGYDYDAIQARVNTLLG

SEQ ID NO: 1427 - protein, 328 aa, unidentified
  REGION 1..328: note = Caudoviricetes sp.
MSNSSLVNMTMLSPNHSGHRNQPITKIAIHHTAGAISAATIGQIFRPTSRQASCNYGIGNDNKIVLCVDEANRSWCTSSSWCDNRAVTIEVANSANGGNWPVSDRTLATLIDLVTDICRRNGIRNCTYTGGKDGVLQKHEWYANTNCPGPYLGSKFSYIASEVNKRLSGNSSSSGGASTSSLYRVRKSWSDSKSQKGAFRDFDNAKKCANANAGYKVFDASGNEVYPNKVTLSKSVDILAHEVLAGNWGNGSDRANRLRAAGYDYDAVQNRVNEILSGTNSNPNRKSIDILAREVIRGDWGNGQDRVNRLTSAGYDYNAVQKRVNEIL

SEQ ID NO: 1428 - protein, 525 aa, unidentified
  REGION 1..525: note = Caudoviricetes sp.
MSEKDLARRSRIKVKFAGVDITSNLMPYLLSLNYTDNEEDETDDLQIKLQDRDGIWLEKWLNNAVESAAEGGTTLNHIPENSSSSTQYVIVNIYKVIATNVNVHGRPGEQYYVYGTLPYGSIITSKGVAEGWVNFDYERKNSYVKAEYLTVIGTKQIEDNSSTQKATTTAKTISVSEKKKGTSKGMKISAVILRENWNSDGKDEMLDCGQFELDSVDASGPPATVTIKATSLPYSSTVRQVQKSKSWENTTLSAIAKKIATDNGMACMFESTADTAYTRVEQYRKSDITFLQQLCHNSGRSLKVTNNIIVIFDQEEYEKKRTVLTLTHGDGKYVKYKLSTGDNDMYTSCRVSYTTSNGAVISATAYVEDYNDTKDDNDKTKNQCLEVRQKVGSKEEAQTLAHKLLRLHNKFEYTANFTLPGNPRLVAGCSVMLKEWGAWSGRYIIKTAKHNISNAGYTTTIDLRKVIDQNVSEEISSKSQADIDNVARAVIRGEWDNGTERKRKLTEAGYDYETVQKRVNEMLGY

SEQ ID NO: 1429 - protein, 335 aa, unidentified
  REGION 1..335: note = Caudoviricetes sp.
MGFSSLIKSQVLASSSNYTQGRKGYKICKITPHHMAGVLSGEQCAKLFQNPNRQASANYCIGNDGGIVGCVDENNRAWTSSSSSNDCQAITIEVSNSSTGGDWPISEAAWNSLVNLCVDICKRHGFTLKYDGTKNGSLTRHNMFAATSCPGKYLQNRFQELADTVNAKLNGSTTSSSNSTSSNKKSNEGIADEVIAGKWGNGDDRKNKLAAAGYDYSAIQSIVNQKLTGKTSNTTTSNKKSIDAIADEVIAGKWGNGNNRKTRLENAGYNYSEVQAAVNNKLSGKSTTSSKKSNETIANEVIKGLWGNGTDRKNKLTAAGYDYNAIQKIVNQKLK

SEQ ID NO: 1430 - protein, 289 aa, unidentified
  REGION 1..289: note = Caudoviricetes sp.
MKIKGVDLSYCQEGISFPALKQAGVKFAIIRAGFSTKKDVTMDKFVADCKKYGIDYGFYWYSYAMSIEQAEAEAKKCISVIKELSPTYPVFFDMEEKKQISGLNTEIRTKMAIAFCKKIRQAGFKTGIYANPSFMEHYYDKSRIVGKYDIWLAHWTNSPDFPSKYNYGQTMWQWGLDRIGGYDIDGDICFTDYGKKKPVKKTIDQLADEVLAGKWDNGAERERLLTAAGYDYNAVQKRVNEKLYKKTVDEIAVEVVAGLWGNGSERKEKLTEAGYDYSEVQRKVNQMIK

SEQ ID NO: 1431 - protein, 289 aa, unidentified
  REGION 1..289: note = Caudoviricetes sp.
MKIKGVDLSYCQEGISFPALKQAGVRFAIIRAGFSTKKDVTMDKFVADCKIHGIEYGFYWYSYAMSVEQALTEAEKCIEVIKNLFPTYPVFFDMEEKNQISGLNTDTRTKMAIAFCEKIRQAGFKPGVYANPSFMENYYDKSRIVVRYDIWLAHWTNSPDCPSKYNYGQTMWQWGLDRIGGYDVDGDICFTDYDKKKPVEKTIDQLADEVLAGKWDNGSERERLLTAAGYDYNAVQKRVNEKLYRKTTDEIAVEVIAGLWGNGSARKEKLTEAGYDYSEVQKRVNEMLG

SEQ ID NO: 1432 - protein, 297 aa, unidentified
  REGION 1..297: note = Anaerostipes caccae L1-92
MTEQKVRKNNMAYTNSKMVSYTKLSPNHSGQRTHSIDRITPHCVVGQCSVETLGNIFAPTSRQASCNYGIGPDGRVGMYVEEKNRSWCSSSNANDQRAVTIECASDTKHPYTMNSTVYATLIKLCTDICRRNGKKKLLWFGDKNKSLNYSPKSDEMVLTVHRWFANKSCPGDWLYSRLGDLAAKVTAELGGSSSGGTTATGLYRVRKTWADVKSQKGAFKSLENAKRCAKANPGYSVFDTNGKVVYGTSASSTKTVDELAREVIQGKWGNGADRKNRLTKAGYNYDAVQKRVNELLR

SEQ ID NO: 1433 - protein, 297 aa, unidentified
  REGION 1..297: note = Oscillospiraceae bacterium
NACYKAGRTITPRGIMVHSTGANNPNLKRYVGPDDGLLGKNQYNNHWNTDKPGGRQVCVHAFIGKLANGMIATYQTLPWNMRGWHCGSGSQGSGNDTHISFEICEDNLSDAAYFNAVYKEAAELCAYLCKQYGIRPERPYLICHSEGHELGIASNHGDVMHWFPKHGKSMDTFRAEVNRLLENGGSEASSSSGSKSVDALAREVIRGNWGNGVERKNRLTAAGHDYAAVQAKVNEILSGKSTSTTETFESYTVAKGDTLWGIAAKKLGSGARYKEIKTLNGLSSDTIYAGQKLKLPK

SEQ ID NO: 1434 - protein, 81 aa, Streptococcus agalactiae
MTRNNQGAFKNLDNAKRCADRFRLKVFDANGKIVYPVGKTIDELAREVISGKWGNGEERKRRLTQAGYDYYAIQRRVNQLL

SEQ ID NO: 1435 - protein, 306 aa, Streptococcus agalactiae
MTIKGIDVSTWQGSIDFNRVKQSGINFVIIRAGYGSALSQKDKWYETNYARAKAAGLHVGAYWYSYAGSAGEAREEARVCKQVLSGKQFDYPIYFDLEEKSQLARGRAFCDSLIRAFCNEMEAGGYFAGFYTSLSAALNYVSPDVRNRYAFWVAQWNSRCTYGGQYGLWQYSSSGSVPGIAGRCDMDLAYVDYPSIIRKGGFNGYGKGTSSAPARKSVDTLAHEVIAGAWGNGEVRVNRLTKAGYDYDAVQARVNELLGIKPKKSIDTLAREVIRGDWGNGKDRVNRLTKAGYDYEAVQKRVNELL

SEQ ID NO: 1436 - protein, 306 aa, Streptococcus pyogenes
MTIKGIDVSTWQGSIDFNRVKQSGINFVIIRAGYGSALSQKDKWFETNYARAKASGLHVGAYWYSYAGSAGEAREEARVCKQVLSGKKFDYPIYFDLEEKSQLARGRAFCDSLIRAFCNEMEAGGYFAGFYTSLSAAVNNVSADVRNRYAFWVAQWNSRCTYGGQYGLWQYSSSGSVPGIAGRCDMDLAYVDYPSIIRKGGFNGYGKGTSFAPARKSVDTLAHEVIAGAWGNGEVRVNRLTKAGYDYDAVQARVNKLLGIKPKKSIDTLAREVIRGDWGNGKDRVNRLTKAGYDYEAVQKRVNELL

SEQ ID NO: 1437 - protein, 306 aa, Streptococcus pyogenes
MTIKGIDVSTWQGSIDFNRVKQSGINFVIIRAGYGSALSQKDKWFETNYARAKAAGLHVGAYWYSYAGSAAEAREEARVCKQVLSGKQFDYPIYFDLEEKSQLARGRAFCDSLIRAFCNEMEAGGYFAGFYTSLSAAVNNVSADVRNCYAFWVAQWNSRCTYQGQYGLWQYSSSGSVPGIAGRCDMDLAYVDYPSIIRKGGFNGYGKGTSSAPARKSVDTLAHEVIAGAWGNGEDRVNRLTKTGYDYDAVQARVNELLGIKPKKSIDTLAREVIRGDWGNGKDRVKRLTKAGYDYEAVQKRVNELL

SEQ ID NO: 1438 - protein, 284 aa, unidentified
  REGION 1..284: note = Ruminiclostridium sp.
MKIKGVDLSYCQEGISFPALKQAGVRFAIIRAGFSTKKDVTMDKFVADCKKYDIDYGFYWYSYAMSIEQAQTEAEKCIEVIKNLSPTYPIFFDMEEKKQIDNLNTDTRTKMAIAFCEKIRQAGFKPGVYANPSFMEHYYDKSRIVGKYDIWLAHWTNSPDCPSRYDYGQTMWQWGVDKIGGYDVDGDICFTDYSSKTVDELADEVLAGKWDNGAERERLLTAAGYDYDAVQKRVNEKLYKKTVDEIAVEVVAGLWGNGSERKEKLTEAGYDYSEVQKRVNEMLG

SEQ ID NO: 1439 - protein, 120 aa, Abiotrophia defectiva
MVIFNFDGGPVDHIGIVERVQADGSISTLEGNYNGRVARAYYDWNHEAIAGYARPRYDQEDKESAPASSEEASPSDDLITAVARDVIRGEYGNGEERVRELTEAGYDYQTVQDRVNQLLS

SEQ ID NO: 1440 - protein, 121 aa, Abiotrophia sp.
MVIFNFDGGPVDHIGIVERVQADGSISTLEGNYNGRVARAYYDWNHEAIAGYARPRYDQDSQEQAPASSEEASPSDDLITAVAWDVIRGEYGNGEERVRELTEAGYDYQTVQDRVNQLLKL

SEQ ID NO: 1441 - protein, 120 aa, Abiotrophia sp.
MVIFNFDGGPVDHIGIVERVQADGSISTLEGNYNGRVARAYYDWNHEAIAGYARPRYDQEGQESAPASSEDTSPNDDLITAVAWDVIRGEYGNGEERVRELTEAGYDYQTVQNRVNQLLS

SEQ ID NO: 1442 - protein, 202 aa, Solobacterium sp.
MPTFNSNSNGTKNNPTNNASKAGMPSNLPKSATVSSRPASKAGMPSNLPKTAPAAAKPAKKPLDEIVKEVIDGAWGAGADRKAKLEAAGYDYNMVQRAVNRVEGASVAELTEVVDQVIRGEFGNGADRKAKLEAAGFDYDKVQAAVNAKLAGKPIAPAGNLDDIAKAVIRGEYGNGADRKAKLEAAGYDYNAVQARVNELLK

SEQ ID NO: 1443 - protein, 176 aa, Solobacterium sp.
MPSFGSSSGNSGSKAGMPSNISHSTSSSTSSSSLKAIDTIVDEVIHGDWGNGADRKAKLEAAGYNFEVIQNRVNRKLSAVGNAGLEAVAKAVIRGEYGNGAERRQRIEAAGYDFAKVQGIVNQMLAGGSAPTGNLDEVAKAVIRGEFGNGAERRQRIEAAGYNFDQVQARVNALLK

SEQ ID NO: 1444 - protein, 51 aa, Ruminococcus sp.
KPQPAKKSIDQIAREVIRGDWGAGEERRKRLTAAGYDYNAVQKRVNEILYG

SEQ ID NO: 1445 - protein, 171 aa, unidentified
  REGION 1..171: note = Stomatobaculum sp.
MGQEGKPISSAFNKLANMKNSAKEEAAPKPAAPAATAFSKFANLKNSAAGAAAQKPAAAAAPAAPAAPKPAAAAPAPTPKPSAPVSTSAPKPSAPVFASAQKPASAPTPAAAPAPAAAPAPAAPQLKSIDEIAKEVIRGNYGNGEERKKKLTAAGYNYEQVQKRVNEMLRK

SEQ ID NO: 1446 - protein, 202 aa, Solobacterium sp.
MPTFNSNSNGTKSAPTNKASKAGMPSNLPKSATVSSRPASKAGMPSNLPKTAPAAAKPAKKPLDEIVKEVIDGAWGAGADRKAKLEAAGYDYNMVQRAVNRVEGASVAELTAVVDQVIRGEFGNGADRKAKLEAAGFDYDKVQAAVNAKLAGKPIAPAGNLDDIAKAVIRGEYGNGADRKAKLEAAGYDYNAVQARVNELLK

SEQ ID NO: 1447 - protein, 71 aa, Solobacterium sp.
LEAAGFDYDKVQAAVNAKLAGKPIAPSGNLDDIAKAVIRGEYGNGADRKAKLEAAGYDYNAVQARVNELLK

SEQ ID NO: 1448 - protein, 212 aa, Solobacterium sp.
MPTFTTSGGKSASTAAKKPVDEIVQEIAKGLWGTGAERKLKLEAAGYDSALIERAVERAGLNKAPAAAPAQKKSVDVIVDEVVSGLWGNGADRKAKLEAAGYDYSLVQRAVDRKLGAGAASLDAVAAAVIRGEYGNGADRKAKLEAAGYNYDQVQAAVNQKLAGGAPAGNLDDVAKAVIRGEYGNGADRRAKLEAAGYNFDQVQARVNQLLK

SEQ ID NO: 1449 - protein, 306 aa, unidentified
  REGION 1..306: note = Clostridiales bacterium
MSKKGIDVSVWQGDIDFNAVKASGVEFVIIRAGYGIGHKDKWFEENYRKAKTAGLDVGAYWYSYASSAGEAALEAQSCVNILSGKSFEYPVYFDLEEKSQLNRGRDFCDSLITSFCNKLEACGYYAGFYTSLSVANNLVSAHIRDRYALWIAQWNTHCSYQGSYGLWQYSSSGSVNGIAGRVDMDYAYADYPSVIKNAGLNGYKNGGSHTAPQTSSIDEVAREVINGDWGNGNERKNRLTSAGYDYTSVQNKVNELLGVKAYRKSVDELAREVIRGTWGNGNTRKQRLTQAGYDYNAVQKRVNELL

SEQ ID NO: 1450 - protein, 329 aa, unidentified
  REGION 1..329: note = Erysipelotrichaceae bacterium
MSNSNLVSYTRLSPNHSGRRTHAIDRITPHCVVGQCSVETLGNIFAPTSREASCNYGIGVDGRVGMYVEEKNRSWCSSSNSNDQRAVTIECASDTKHPYWMNDKVYSTLIKLCVDICKRNGKKKLIWIADKNKSLNYAPKSDEMVLTVHRWFANKSCPGDWLYSRLGDLAKKVTAELGGSSVTPSKSLYRVRKSWSDSKSQVGAFSVFDNAKRCADSHKGYFVFDERGNVVYPKSNKKSVDELAREVIKGLWGNGSDRKNKLTSAGYDYDAVQKRVNELLYVSSKKSIDTIAREVIRGDWGNGTDRKNRLIAAGYDYNAVQRRVNEILS

SEQ ID NO: 1451 - protein, 586 aa, unidentified
  REGION 1..586: note = Oscillospiraceae bacterium
MSDSNLARRTDLQVFFAGTDISEAVNKDLSSFTYTDNEEDETDDLQIKLNDRSGKWLTKWLDTAINAAAEGGKTLDTKPTSSDGQKKDKTAKYKVIATGGANIRSSPGEMYSIRGTLSYGTIIEVIDVTNGWAYFTYSGKHAYVAVKCLQLVSGGSASTSGSSQSVTTTSSVTWNIGDEVIVNGRPQYSSYGTGTPGANVTNYKGKITHLNLKSGIPYPIHVDYLGWFAESQVEKVNSGAVSTEQAGSKGLKISAVIVRSNWNSDGKDDVLDCGQFELDSVDVSGPPATLTIKGTSLPYSSTIRQTLKSKSWENISLSGICQQIAGRNGMTCMFESKNNPKYTRVEQYQTSDIAFLKTLCHNAGCSLKVTNNILVIFDQEEYESKAAVRTIKFGVEGGYTKYKLSTGANDHYASCRVSYTNTSGNVISATAYVEDYKDGEDNQCLEVHQKVESIAEAQALAHKLLRLHNKYEFEASFTFPGDTTLVAGNAVMLEGFGAWNGKYMIKQSKHSISSSGYTTQISLRKALPANETVNSSSTATSADIDELARQCIRGDWGNGEERKRRLTEAGYDYKTVQKRVNEMLGM

SEQ ID NO: 1452 - protein, 586 aa, unidentified
  REGION 1..586: note = Oscillospiraceae bacterium
MSDSNLARRTDLQVFFAGTDISEAVNKDLSSFTYTDNEEDETDDLQIKLNDRSGKWLTKWLDTAINAAAEGGKTLDTKPTSSDGQKKDKTAKYKVIATGGANIRSSPGEMYSIRGTLSYGTIIEVIDVTNGWAYFTYSGKHAYVAVKCLQFVSGGSASTSGSSQSVTTSSSVTWNIGDEVIVNGRPQYSSYGTGTPGANVTNYKGKITHLNLKSNIPYPIHVDYLGWFAESQVEKVNGGAASTEQAGSKGLKISAVIVRRNWNSDGKDDVLDCGQFELDSVDVSGPPATLTIKGTSLPYSSTIRQTLKSKSWENISLSGICQQIAGRNGMTCMFESRNNPKYTRVEQYQTSDIAFLKTLCHNAGCSLKVTNNILVIFDQEEYESKATVRTIKFGEKGGYTKYKLSTGANDQYASCRVSYTNASGNVISATAYVEDYKDGEDNQCLEVHQKVESIAEAQALAHKLLRLHNKYEFEASFTFPGDTTLVAGNAVMLEGFGAWNGKYMIKQSKHSISSSGYTTQISLRKALPANEAVNSSSTATSADIDELARQCIRGDWGNGEERKRRLTEAGYDYKTVQKRVNEMLGM

SEQ ID NO: 1453 - protein, 290 aa, unidentified
  REGION 1..290: note = Lachnospiraceae bacterium
MAYTNSSMVAYTKLSPNHSGQRTHSIDRITPHCVVGQLSAESICGCFTSPSRQASCNYGIGTDGKVSLCVEEKNRSWCSSSNANDQRAVTIECASDKTEPYAMNSKVYDSLIKLCTDICKRNGKKKLLWLGDRNKVLNYTPKSDEMVLTVHRWFANKSCPGGWLYARLGDLAAKVTAALGSPSEPKPASNKKQLYRVRKTWTDSKSQKGAFSVLANAKKCVDSNKGYSVFDENGKKVYPADAPGTKKSIDAIAREVIRGDWGNGDERKQKLTAAGYNYSAVQKKVNELLK

SEQ ID NO: 1454 - protein, 286 aa, Clostridium sp.
MAYTNSPLVAYTNLSPNHSGQRTHSIDRITPHCVVGQLSAESICGCFTSPSRQASCNYGIGTDGRVSLCVEEKNRSWCSSSNANDQRAVTIECASDKTEPYAMNGKVYDSLVSLCADICRRNGKTKLLWLGDKDKTLNYAPKSDEMVLTVHRWFANKSCPGNWLYARLGDLAEKVTAALGTPAAKPTESSASSGLYRVRKTWADSKSQKGAFSVLANAKRCADSNSGYSVFGENGNKVYPAGKSVDDIAREVIRGDWGNGDERRKRLAAAGYDYSAVQKRVNELLK

SEQ ID NO: 1455 - protein, 339 aa, Clostridium innocuum
MSYTNSSLVSYTELSPNHSGQRTHSIDRITPHCVVGQLSAESICACFPAGREASCNYGIGTDGRVSLCVEEKNRSWCSSSNDNDQRAVTIECASDRTEPYAMNSKVYDSLVRLCIDICRRNGKKKLLWFSDKNKSLNYNPKPDEMVLTVHRWFANKNCPGNWLYARLGDLANEVTAALGGTATNTPSSAGNAWYRVRKSWADAKSQKGAFHSLKNATKCANANSGYKVFDDSGNQIYPVATVPSSSIDTIAREVINGHWGNGNERKQRLTAAGYDYNAVQTRVNEILSGTSNSPSKSITEVAKEIIRGDWGNGAERKQRLTAAGYDYASVQAKVNELLR

SEQ ID NO: 1456 - protein, 290 aa, Eubacterium siraeum
MMKIKGVDLSYCQEGISFPALKQAGVRFAIIRAGFSTKKDVTMDKFVADCKIHGIEYGFYWYSYAMSVEQAQTEAEKCIEVIKNLSPTYPVYFDMEEKKQVSGLSTDTRTKMAIAFCEKISQAGFKPGVYANPSFMENYYDKSRIVGRYDIWLAHWTNSPNCQSKYNYGQTMWQWGLDKIDGYDIDGDICFFDYAKSAPEKKTVDELADEVIAGKWDNGAERERLLTAAGYDYNAVQKRVNEKLYRKTTDEIAVEVIAGLWGNGAERKEKLTEAGYDYSEVQRKVNQLIK

SEQ ID NO: 1457 - protein, 287 aa, Carnobacterium sp.
MVEKINETLMSDSGRLVNLEFVVIHNDAGSMTPKQYIDWLRYRDKALGIAHYYCNRDCIARVVDTFNIGYHTGDWWSNCRSIGYEVCESMKVSDTEFLQNEDVTLMQATEDLLFYGLPITTQTVRLHHEFVPTTCPHRSMELHGGSTESVKKYFVDRMNYFATLGSTVEEMMGQYNGEVTVEKVTSKGNTLKSDETVANEVLQGLWGNGNERIKLLTNAGYDAQKIQDIVNQLVLGEDVEDIVDIDEVAQEVIQGEWGNGDERKVRLENAGYHYQAVQDRVNELLGE

SEQ ID NO: 1458 - protein, 159 aa, unidentified
  REGION 1..159: note = Lagierella massiliensis
IDLVTDICKRNGIKNCTYTGGKDGVLQKHEWYANTNCPGPYLGSKFSNIASEVNKRLKGNNTVCKPSTGLYRVRKSWSDVKSQKGAFKNLDNAKKCADRFGLKVFDANGQMIYPVRKTTDQLAREVIRGDWGNGDERKRRLTQAGYDYYAVQKRVNQLL

SEQ ID NO: 1459 - protein, 42 aa, unidentified
  REGION 1..42: note = Clostridioides sp.
MNAIADAVIRGDYGNGESRRQRIIAAGYDYNAVQALVNKKLG

SEQ ID NO: 1460 - protein, 261 aa, unidentified
  REGION 1..261: note = Coriobacteriales bacterium
MGKREKMVQYVIDACNDASVGYSQVRRWRDPDVDCSSLMYLAAHAAGYAIPRAIGSGYTGTMRQDFEAAGFVWYPFNGQVNDSDPGEIYLNTQNHTEMYVGNGKFGGAHIDENGGVTGARGGDQTGNEVSMVNAYIYSRGWDGVLVPPDSGGESSVPSAPAKTIDTLAKEVIGGLWGTGAERRQRLIDAGYDYEAVQRRVNEIIAGSNESAGNVTPAPDIDSIAWAVIRGEYGNGQSRIDALVSAGYDASAVQASVNELLS

SEQ ID NO: 1461 - protein, 269 aa, Peptococcus niger
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKRLRGDKTVSKKAGELYRVRGSWSDVKSQKGAFKNLDNAKRCADRFRLKVFDANGKIVYPKDKTIDQLAREVISGKWGNGEERKRRLTQAGYDYYAIQRRVNQLL

SEQ ID NO: 1462 - protein, 218 aa, Streptococcus sp.
ASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIANEVNKRLRGDKTVSKPTCGLYRVRKSWSDVKSQKGAFKNLDNAKRCADRFRLKVFDSNGKIVYPVGKTIDQLAREVIRGDWGNGDERKRRLTQAGYDYFAIQKRVNQLL

SEQ ID NO: 1463 - protein, 306 aa, Alloscardovia omnicolens
MSKRGIDVSVWQGDIDFNAVKASGVEFVIIRAGYGIGHKDKWFEENYRKAKTAGLDVGAYWYSYASSAGEAALEAQSCVNILSGKSFEYPVYFDLEEKSQLNRGRDFCDSLITSFCNKLEACGYYAGFYTSLSVANNLVSSRVRDRYALWIAQWNTHCDYQGSYGLWQYSSSGSVGGIAGRVDMDYAYVDYPSVIKNAGLNGYKNGGSYTAPQASSIDEVAREVINGDWGNGNERKNRLTQAGYDYTSVQNKVNELFGVKAYRKSVDELAREVIRGTWGNGSTRKQRLTQAGYDYDAVQKRVNELL

SEQ ID NO: 1464 - protein, 283 aa, Varibaculum cambriense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPVWGKNVFGHRNFSATECPASIAGSQHATYMARACYWYDQMASSKVSATPAPASKPAPTGCKSIDTLAHEVINGSWGNGNDRYQRLTAAGFDYDAVQARVNEILGLKAKPAGKSIETLAREVIRGDWGNGQERYNRLTNAGYNYQQVQARVNQKLGC

SEQ ID NO: 1465 - protein, 284 aa, Varibaculum sp.
MKDWNNLQADQNLLMNKHYTAGRGGRSINKIVLHHNAGRLSIQECWNVWQTRQASAHYQVDVNGRIGQLVWDRDTAWHAGNWEANCTSIGIEHANNHVGNPWTISDATLENGAHLVAALCRYYKLGRPAWGKNVFGHKHFAATGCPGEIAGTQNTRYMARAQYWYDHMTSSKAPTPEAKSVSKPVTTSGKSVDELAREVIRGDWGNGNDRYQRLTAAGFDYDAVQARVNQVLGQKPKPAGKSIDMLAREVIRGDWGNGQERYNRLTNAGYNYNTVQARVNQILS

SEQ ID NO: 1466 - protein, 306 aa, Streptococcus anginosus
MTIKGIDVSTWQGSIDFKRVKQSGINFVIIRAGYGSALSQKDKWFETNYARAKAAGLHVGAYWYSYAGSAGEAREEARICKQVLSGKQFDYPIYFDLEEKSQLARGRAFCDSLIRAFCNEMEAGGYFAGFYTSLSAALNYVSPDVRNRYAFWVAQWNSRCTYGGQYGLWQYSSSGSVPGIAGRCDMDLAYVDYPSIIRKGGFNGYGKGTSSAPARKSVDTLAHEVIAGAWGNGEVRVNRLTKAGYDYDAVQARVNELLGIKPKKSIDTLAREVIRGDWGNGKDRVNRLTKAGYDYEAVQKRVNELL

SEQ ID NO: 1467 - protein, 307 aa, unidentified
  REGION 1..307: note = Caproiciproducens sp. NJN-50
MNLHKLILTSNACYKAGRTITPRGIMVHSTGANNPNLKRYVGPDDGLLGKNQYNNHWNTDKPGGRQVCVHAFIGKLANGMIATYQTLPWNMRGWHCGSGSQGSGNDTHISFEICEDNLSDAAYFNAVYKEAAELCAYLCKQYGIRPERPYLICHSEGHELGIASNHGDVMHWFPKHGKSMDTFRAEVNRLLENGGSEASSSSGSKSVDALAREVIRGNWGNGVERKNRLTAAGHDYAAVQAKVNEILSGKSTSTTETFESYTVAKGDTLWGIAAKKLGSGARYKEIKTLNGLSSDTIYAGQKLKLPK

SEQ ID NO: 1468 - protein, 331 aa, unidentified
  REGION 1..331: note = Microbacterium phage PrincePhergus
MAKFSSLITGTTPDHGKNRGSDPNKKRIIVHHWAGTSGGDTALMKPKGQNSRGDVSASYILYSDGRLVGQVSEEFSPWTTGSADWGSVTVETQNAKGAPNWDIDARAKEKLAQLMADLSDRYGWGELRLGTNVRYHGEFYATACPGPDMIRSLPSIVARANQLRKGGGGSQPSTGGTYTVVKGDTLSGIAGKYGTTWQELQRLNGLADPNKIFPGQKIKVPSGGGSTPSKPSQSISDVAKAVIRGDYGNGQDRVNRLRAAGYDPAEVQQEVNRQLYGGGSKTPVASNVDAVARQVIRGDWGNDPERKKRLTAAGYDYSAVQRRVNEILAGK

SEQ ID NO: 1469 - protein, 332 aa, unidentified
  REGION 1..332: note = Microbacterium phage Theresita
MAKFSSLISGTTPDHGKNRGKDPNKTRIIVHHWAGTTGGDTALMKPKGQNSRGDVSASYILYSDGRLIGQVSEEFSPWTTGSADWGSVTVETQNAKGAPNWDIDARAKEKLAQLMADLSDRYGWGELKLGTNVRMHREFNATACPGPDMVASLPSIVARANQLRKGGGGSTPTPTPSGGTYTVSKGETLSSIAAKYGTTWQALQALNGLSDPNKIYPGQKIKVPSGGGSANPSESISAVAKRVIRGDFGNGQDRVNRLRAAGYDPAEVQAEVNRQLGGGGSKTPAPSNVDAIARQVIRGDWGNDPERKRKLTAAGYDYSAVQRRVNEILAGK

SEQ ID NO: 1470 - protein, 331 aa, unidentified
  REGION 1..331: note = Microbacterium phage Sinatra
MAKFSSLINGTTPDHGKNRGSDPNKKRIIVHHWAGTSGGDTALMKPKGQNSRGDVSASYILYSDGRLVGQVSEEFSPWTTGSADWGSVTVETQNAKGAPNWDIDARAKEKLAQLMADLSDRYGWGELRLGTNVRYHGEFYATACPGPDMIASLPSIVARANQLRKGGGGSQPSTGGTYTVVKGDTLSGIAGKYGTTWQELQRLNGLADPNKIFPGQKIKVPSGGGSTPSKPSQSLADVAKAVIRGDYGNGQDRVNRLRAAGYDPAEVQQEVNRQLYGGGSKTPVASNVDAVARQVIRGDWGNDPERKKRLTAAGYDYSAVQRRVNEILAGK

SEQ ID NO: 1471 - protein, 219 aa, Abiotrophia defectiva
MTIMGQADKLINVAQSYLGTSQWSDDHLAMVDAYNSVSPIPVGYAVQYGDDWCDIFVTVCGDEAGISHLIGRECGVPRHLAWFQEQGIWLGQEWPQAGDIVIFNFDGGPVDHIGIVERVQADGSISTLEGNYNGRVARAYYDWNHEAIAGYARPRYDQDSQESAPASSEDTSPSDDLITAVAWDVIRGEYGNGEERVRELTEAGYDYQTVQDRVNQLLS

SEQ ID NO: 1472 - protein, 306 aa, unidentified
  REGION 1..306: note = Bifidobacteriaceae bacterium NR020
MSKRGIDVSVWQGDIDFNAVKASGVEFVIIRAGYGIGHKDKWFEENYRKAKTAGLDVGAYWYSYASSAGEASEEAQSCVNILSGKSFEYPIYFDLEEKSQLNRGRAFCDSLITSFCSKLEACGYYAGFYTSLSVANNLVSSHVRDRYALWIAQWNTHCSYEGSYGLWQYSSSGSVSGIAGRVDMDYAYVDYPSVIKNAGLNGYKNGGSYTAPQTSSIDEVAREVINGDWGNGAERKQRLTSAGYDYASVQNRVNELLGVKAYRKSVDELAREVIRGVWGNGAERKQRLSQAGYDYDTVQKRVNELL

SEQ ID NO: 1473 - protein, 306 aa, unidentified
  REGION 1..306: note = Bifidobacteriaceae bacterium NR016
MSKKGIDVSVWQGDIDFNSVKASGVEFVIIRAGYGIGHKDKWFEENYRKAKTAGLDVGAYWYSYASSAGEASEEAQSCVNILSGKSFEYPVYFDLEEKSQLNRGRAFCDSLITSFCNKLETYGYYAGFYTSLSVANNLVSSHVRDRYALWIAQWNTHCDYQGSYGLWQYSSSGSVGGIAGRVDMDYAYVDYPSVIKKAGLNGYKNGGSYTAPQTSSIDEVAREVINGDWGNGTERKKRLTSAGYDYTSVQNKVNELLGVKAYRKSVDELAREVIRGTWGNGSMRKQRLTQAGYDYDAVQKRVNELL

SEQ ID NO: 1474 - protein, 66 aa, Catonella sp.
PRYGQDSQESAPASSEATTPSDDLITAVAWDVIRGEYGNGEERVRELTEAGYDYQTVQDRVNQLLS

SEQ ID NO: 1475 - protein, 328 aa, unidentified
  REGION 1..328: note = Peptostreptococcaceae bacterium pGA-8
MSNSSLVSIVNYSPNHSGRRNQPITKIAIHHTAGAVSAATIGQIFKPTSRQASCNYGIGNDNKIVLCVDESNRSWCTSSSWCDNRAVTIEVANSSNGGNWPVSDRVLATLIDLVTDICRRNGIKNCTYTGGKDGVLQKHEWYAATNCPGPYLGSKFTYIASEVNKRLHGGSSASPVTQGSSLYRVRKSWSDAKSQKGAFRNLDNAKKCANANPGYSVYDANGNAVYPVANAPSKSIDSLAREVIAGNWGNGQDRVNRLRAAGYNYNAVQNRVNEILSGSASKPAGKSIDTLAREIIRGDWGNGQNRKNRLERAGYDYNAVQRRVNELL

SEQ ID NO: 1476 - protein, 319 aa, unidentified
  REGION 1..319: note = Bacteriophage sp.
MAGDLSVETCGNLFVNPNREASANYGIGSDGRVGLYVDEGDRAWASASPSNDNRAVNIEVANCATGGDWPVSDAAYSKLIDLCVDICQRNGIKALNYTGGADGNLTEHRMFTATACPGPYLHKRMGRIAAKVNSRLSAQPAKSVDEVAREVIRGEWGNGSDRRQRLESAGYDYDAMQDRVNELLNSKEEPEQPGKPTTLDVNVGEIVDFKGGKHYTSANATSGTEVKASKAKVTAKSSGKHPIHLRAIINDKGAYISGVYGWVDLSTITTGSVVKKSVNEIAREVIAGKWGNGAERRCKLESAGYDYAAVQKRVNELLR

SEQ ID NO: 1477 - protein, 330 aa, unidentified
  REGION 1..330: note = Microbacterium phage SirVictor
MVFSPLTARTVAHHGKHRGSDPKKTRIIVHHWAGTSGGDTALMKPKGQNSRGDVSASYILYNDGTLVGQVPEELSPWTTGSADWGSVTVETQNKRGAPNWDIDSRAKEKLAQLMADLSDRYGWGELRLGTNVRMHREFNATACPGPDMVASLPSIVARANQLRKGGGGSTPTPGGTYTVAKGDTLSGIAGKYGTTWQELQKLNGLADPNKIFPGQKIKVPSGGGSTPTKPSQSLADVAKAVIRGDYGNGSTRVAKLRAAGYDPAEVQAEVNRQLYGGGSKTPVASNVDAVARQVIRGDWGNDPERKKRLTAAGYDYSAVQRRVNEILAGK

SEQ ID NO: 1478 - protein, 287 aa, unidentified
  REGION 1..287: note = Clostridia
MAYTNSKMVSYTKLSPNHSGQRTHSIDRITPHCVVGQCSVETLGNIFAPTSRQASCNYGIGPDGRVGMYVEEKNRSWCSSSNANDQRAVTIECASDTKHPYTMNSTVYATLIKLCTDICRRNGKKKLLWFGDKNKSLNYSPKSDEMVLTVHRWFANKSCPGDWLYSRLGDLAAKVTAELGGSSSGGTTATGLYRVRKTWADVKSQKGAFKSLENAKRCAKANPGYSVFDTNGKVVYGTSASSTKTVDELAREVIQGKWGNGADRKNRLTKAGYNYDAVQKRVNELLR

SEQ ID NO: 1479 - protein, 306 aa, unidentified
  REGION 1..306: note = Kallipyga massiliensis
MTIKGIDVSTWQGSIDFNRVKQSGINFVIIRAGYGSALSQKDKWFETNYARAKASGLHVGAYWYSYAGSAGEAREEARVCKQVLSGKQFDYPIYFDLEEKSQLACGRAFCDSLIRAFCNEMEAGGYFAGFYTSLSAAVNNVSADVRNRYAFWVAQWNSRCTYGGQYGLWQYSSSGSVPGIAGRCDMDLAYVDYPSIIRKGGFNGYGKGTSSAPARKSVDTLAHEVIAGAWGNGEVRVNRLTKAGYDYDAVQARVNKLLGIKPKKSIDTLAREVIRGDWGNGKDRVNRLTKAGYDYEAVQKRVNELL

SEQ ID NO: 1480 - protein, 306 aa, unidentified
  REGION 1..306: note = Levyella massiliensis
MTIKGIDVSTWQGSIDFKRVKQSGINFVIIRAGYGSALSQKDKWFETNYARAKAAGLHVGAYWYSYAGSAAEAREEARVCKQVLSGKQFDYPIYFDLEEKSQLARGRAFCDSLIRAFCNEMEAGGYFAGFYTSLSAAVNNVSADVRNRYAFWVAQWNSRCTYQGQYGLWQYSSSGSVPGIAGRCDMDLAYVDYPSIIRKGGFNGYGKGTSSAPARKSVDTLAHEVISGAWGNGEDRVNRLTQTGYDYDAVQARVNELLGIKPKKSIDTLAREVIRGDWGNGKDRVNRLTKAGYDYEAVQKRVNELL

SEQ ID NO: 1481 - protein, 306 aa, unidentified
  REGION 1..306: note = Gardnerella pickettii
MSKRGIDVSVWQGDIDFNAVKASGVEFVIIRAGYGIGHKDKWFEQNYRKAKTTGLDVGAYWYSYASSAGEAAEEAQSCVNILSGKSFEYPVYFDLEEKSQLNRGRDFCDSLITSFCNKLETYGYYAGFYTSLSVANNLVSSHVRDRYALWIAQWNTHCDYQGSYGLWQYSSSGSVDGIAGRVDMDYTYVDYPSVIKKAGLNGYKNGGSYTAPQTSSIDEVAREVINGDWGNGNERKNRLTSAGYDYTSVQNKVNELLGVKAYRKSVDELAREVIRGTWGNGSTRKQRLTQAGYDYDAVQKRVNELL

SEQ ID NO: 1482 - protein, 306 aa, unidentified
  REGION 1..306: note = Actinotignum urinale
MTIKGIDVSTWQGSIDFKRVKQSGINFVIIRAGYGSTLSQKDKWFETNYACAKAAGLHVGAYWYSYAGSAGEAREEARVCKQVLSGKQFDYPIYFDLEEKSQLARGRAFCDSLIRAFCNEMEAGGYFAGFYTSLSAALNYVSPDVRNRYAFWVAQWNSRCTYGGQYGLWQYSSSGSVPGIAGRCDMDLAYVDYPSIIRKGGFNGYGKGTSSAPARKSVDTLAHEVIAGAWGNGEVRVNRLTKAGYDYDAVQARVNELLGIKPKKSIDTLAREVIRGDWGNGKDRVNRLTKAGYDYEAVQKRVNELL

SEQ ID NO: 1483 - protein, 216 aa, Abiotrophia defectiva
MGQADKLINVAQSYLGTSQWSDDHLAMVDAYNSVSPIPVGYAVQYGDDWCDIFVTVCGDEAGISHLIGRECGVPRHLAWFQEQGIWLGQEWPQAGDIVIFNFDGGPVDHIGIVERVQADGSISTLEGNYNGRVARAYYDWNHEAIAGYARPRYDQDSQESAPASSEDTSPSDDLITAVAWDVIRGEYGNGEERVRELTEAGYDYQTVQDRVNQLLS

SEQ ID NO: 1484 - protein, 306 aa, Gardnerella vaginalis
MSKKGIDVSVWQGDIDFNSVKASGVEFVIIRAGYGIGHKDKWFEENYRKAKTAGLDVGSYWYSYASSAGEASEEAQSCVNILSGKSFEYPIYFDLEEKSQLNRGRDFCDSLITSFCNKLEACGYYAGFYTSLSVANNLVSSHVRDRYALWIAQWNTHCSYQGSYGLWQYSSSGSVNGIAGRVDMDYAYVDYPSVIKNAGLNGYQNGGSYTAPQTSSIDEVAREVINGDWGNGNDRKNRLISAGYDYASVQNKVNELLGVKAYRKSVDELAREVIRGTWGNGSMRKHRLTQAGYDYDAVQKRVNELL

SEQ ID NO: 1485 - protein, 269 aa, unidentified
  REGION 1..269: note = Anaerococcus
MSNSALVQARILSPNHSGRRNQRITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIANEVNKRLRGDKTVSKPTGGLYRVRKYWSDIKSQKGAFKNLDNAKRCADRFGLKVFDANGKIVYPVGKTIDQLAREVIRGDWGNGEERKRKLTNAGYDYYAVQKRVNQLL

SEQ ID NO: 1486 - protein, 306 aa, unidentified
  REGION 1..306: note = Terrabacteria group
MTIKGIDVSTWQGSIDFNRVKQSGINFVIIRAGYGSALSQKDKWFETNYARAKAAGLHVGAYWYSYAGSAAEAREEARVCKQVLSGKQFDYPIYFDLEEKSQLARGRAFCDSLIRAFCNEMEAGGYFAGFYTSLSAAVNNVSADVRNRYAFWVAQWNSRCTYQGQYGLWQYSSSGSVPGIAGRCDMDLAYVDYPSIIRKGGFNGYGKGTSSAPARKSVDTLAHEVIAGAWGNGEDRVNRLTKTGYDYDAVQARVNELLGIKPKKSIDTLAREVIRGDWGNGKDRVNRLTKAGYDYEAVQKRVNELL

SEQ ID NO: 1487 - protein, 312 aa, unidentified; identical to SEQ ID NO: 153
  source 1..312: note = Murdochiella vaginalis

SEQ ID NO: 1488 - protein, 328 aa, Eubacterium callanderi
MSNSRLVDMTMLSPNHSGRRNQPITKIAIHHTAGAISAATIGNIFRPTSRQASCNYGIGNDNKIVLCVDESNRSWCTSSSWCDNRAITIEVSNSSNGGNWPVSDMVLAKLIDLVTDICRRNGIKNCTYTGGKDGVLQKHEWYAATNCPGSYLGSKFSYIASEVNKRLSGNSSSSGGTSTSSLYRVRKSWSDAKSQKGAFRSLENAKKCVNSNSGYKVYDANGNEVYSNKSTSSKSIDTLAREVIAGNWGNGQDRVNRLRTAGYDYNAVQNRVNAILSGSASKPSGKSIDTLAREVIRGEWGNGQDRKNRLERAGYDYNTVQIRVNELL

SEQ ID NO: 1489 - protein, 306 aa, Atopobium minutum
MAMKGIDVSTWQGSIDFNRVKQSGINFVIIRAGYGSALSQKDKWFETNYARAKAAGLHVGAYWYSYAGSAGEAREEARICKQVLSGKQFDYPIYFDLEEKSQLARGRAFCDSLIRAFCNEMEAGGYFAGFYTSLSAALNYVSPDVRNRYAFWVAQWNSRCTYGGQYGLWQYSSSGSVPGIAGRCDMDLAYVDYPSIIRKGGFNGYGKGTSSAPARKSVDTLAHEVIAGAWGNGEVRVNRLTKAGYDYDAVQARVNELLGIKPKKSINALAREVIRGDWGNGKDRVNRLTKAGYDYEAVQKRVNELL

SEQ ID NO: 1490 - protein, 306 aa, Atopobium minutum
MAMKGIDVSTWQGSIDFNRVKQSGINFVIIRAGYGSALSQKDKWFETNYARAKAAGLHVGAYWYSYAGSAGEAREEARICKQVLSGKQFDYPIYFDLEEKSQLARGRAFCDSLIRAFCNEMEAGGYFAGFYTSLSAALNYVSPDVRNRYAFWVAQWNSRCTYQGQYGLWQYSSSGSVPGIAGRCDMDLAYVDYPSIIRKGGFNGYGKGTSSAPARKSVDTLAHEVIAGAWGNGEDRLNRLTKTGYDYDAVQARVNELLGIKPKKSINALAREVIRGDWGNGKDRVNRLTKAGYDYEAVQKRVNELL

SEQ ID NO: 1491 - protein, 306 aa, Gardnerella vaginalis
MSKRGIDVSVWQGDIDFNAVKASGVEFVIIRAGYGIGHKDKWFEENYRKAKTAGLDVGAYWYSYASSAGEASEEAQSCVNILSGKSFEYPVYFDLEEKSQLNRGRAFCDSLITSFCNKLEACGYYAGFYTSLSVANNFVSAHIRDRYALWIAQWNTHCSYQGSYGLWQYSSSGSVNGIAGRVDMDYAYVDYPSVIKTAGLNGYQNGGSHTAPQTSSIDEVAREVINGDWGNGNERKNRLTSAGYDYTSVQNKVNELLGVKAYRKSVDELAREVIRGTWGNGNTRKQRLTQAGYDYNAVQKRVNELL

SEQ ID NO: 1492 - protein, 412 aa, unidentified
  REGION 1..412: note = Hornefia porci
MGYTNSKLVAYKKLSPNHSGRRTHTIDRISPHCVVGQCTAEGLGSWFAKSSTQASSNYGIDRDGRVGLYVEEKNRSWCTSSNANDQRAVTIECASDTKEPYRMNSRVYATLVKLCVDICKRNGKKKLLWLGDKSRTLNYTPKSDEMVITVHRWFANKSCPGNWLYSRLGKLAKEVTRQLGGSEKKITTGLKASSLKNLSDADVIRKVGALFTADQKKSGILASVSLAQFILESGYGKSELAQNANNCFGMKKSLSGNTWSGSVWDGKSVYTKKTKEQSKDGSYITVTADFRKYPDIEKSIADHSAYLNGAKNGSKLRYAGLKGCRNYRKAIKIIRAGGYATSLTYVDKLCRIIEKWNLTRYDVKVDSRKSVNALAEEVIAGKWGNGSERKKRLTAAGYDYNAVQRRVNEILK

SEQ ID NO: 1493 - protein, 306 aa, Gardnerella vaginalis
MSKKGIDVSVWQGDIDFNAVKASGVEFVIIRAGYGIGHKDKWFEENYRKAKTAGLDVGSYWYSYASSAGEAALEAQSCVNILSGKSFEYPVYFDLEEKSQLNRGRDFCDSLITSFCNKLEACGYYAGFYTSLSVANNLVSSHVRDRYALWIAQWNTHCSYEGSYGLWQYSSSGSVNGIAGRVDMDYAYVDYPSVIKNAGLNGYQNGGSYTAPQTSSIDEVAREVINGDWGNGNERKNRLTSTGYDYTSVQNKVNELLGVKAYRKSVDELAREVIRGTWGNGSTRKQRLTQAGYDYDAVQKRVNELL

SEQ ID NO: 1494 - protein, 306 aa, Gardnerella vaginalis
MSKKGIDVSVWQGDIDFNAVKASGVEFVIIRAGYGIGHKDKWFEENYRKAKTAGLDVGSYWYSYASSAGEASLEAQSCANILSGKSFEYPIYFDLEEKSQLNRGRAFCDSLITSFCNKLETCGYYAGFYTSLSVANNLVSAHVRNRYALWIAQWNTHCDYQGSYGLWQYSSSGSVGGIAGRVDMDYAYVDYPSVIKNAGLNGYKNGGSYTAPQTSSIDEVAREVINGDWGNGNERKNRLTSAGYDYASVQNKVNELLGVKAYRKSVDELAREVIRGTWGNGSTRKQRLTQAGYDYDAVQKRVNELL

SEQ ID NO: 1495 - protein, 306 aa, unidentified
  REGION 1..306: note = Gardnerella sp. DNF01162
MSKKGIDVSEWQGDIDFNAVKASGIEFVIIRAGYGIGCKDKWFEQNYRKAKTAGLDVGAYWYSYANSAGEASEEAQSCVNMLSGKSFEYPVYFDLEEKSQLNRGRVFCDSLITSFCSKLEACGYYAGFYTSLSVANNLVSSHVRNRYALWIAQWNTHCSYQGSYGLWQYSSSGSVPGVAGRVDMDYAYVDYPSVIKNAGLNGCKNGGSDQATRTSSIDEVAREVINGAWGNGNERKQRLTSAGYDYASVQNKVNKLLGVKTRRKSVDELAREVIRGTWGNGNERKQRLTQAGYDYATVQKRVNELL

SEQ ID NO: 1496 - protein, 306 aa, unidentified
  REGION 1..306: note = Gardnerella sp. KA00735
MSKKGIDVSVWQGDIDFNAVKASGVEFVIIRAGYGIGCKDKWFEENYRKAKTAGLDVGAYWYSYASSAGEADLEAQSCVNILSGKSFEYPVYFDLEEKSQLNRGRDFCDSLITSFCNKLEACGYYAGFYTSLSVANNLVSSHVRDRYALWIAQWNTHCSYQGSYGLWQYSSSGSVNGIAGRVDMDYAYVDYPSVIKNAGLNGYQNGGSYTAPQTSSIDEVAREVINGDWGNGNERKNRLTSAGYDYTSVQNKVNELLGVKAYRKSVDELAREVIRGTWGNGNTRKQRLTQAGYDYNAVQKRVNELL

SEQ ID NO: 1497 - protein, 306 aa, unidentified
  REGION 1..306: note = Gardnerella swidsinskii
MSKKGIDVSVWQGDIDFNAVKASGVEFVIIRAGYGIGHKDKWFEENYRKAKTAGLDVGSYWYSYASSAGEAALEAQSCVNILSGKSFEYPIYFDLEEKSQLNRGRDFCDSLITSFCNKLEACGYYAGFYTSLSVANNLVSAHVRDRYALWIAQWNTHCSYQGSYGLWQYSSSGSVDGIAGRVDMDYAYVDYPSVIKNAGLNGYQNGGSYTAPQTSSIDEVAREVINGDWGNGNERKNRLISAGYDYASVQNKVNELLGVKAYRKSVDELAREVIRGTWGNGNTRKQRLTQAGYDYNAVQKRVNELL

SEQ ID NO: 1498 - protein, 306 aa, Gardnerella vaginalis
MSKKGIDVSEWQGDIDFNAVKASGVEFVIIRAGYGTGCKDKWFEQNYRKAKTVGLDVGAYWYSYASSAGEASEEAQSCVNMLSGKSFEYPIYFDLEEKSQLNRGRAFCDSLITSFCSKLETYGYYAGFYTSLSTANNLVSSHVRNRYALWIAQWNTHCNYQGSYGLWQYSSNGSVPGVAGRVDMDYAYKDYPSIIKNAGLNGYKNGGSDQAARTSSIDEVAREVINGAWGNGNERKQRLTSAGYDYASVQNKVNELLGVKAYRKSVDELAREVIRGTWGNGNERKQRLTQAGYDYATVQKRVNELL

SEQ ID NO: 1499 - protein, 329 aa, unidentified
  REGION 1..329: note = Longibaculum muris
MSNSNLVSFTRLSPNHSGRRTHAIDRITPHCVVGQCSVETLGNIFAPTSREASCNYGIGVDGRIGMYVEEKNRSWCSSSNSNDQRAVTIECASDTKHPYWMNDKVYSTLIKLCVDICRRNGKKKLLWFGDKNKSLNYSPKSDEMVLTVHKWFASKSCPGDWLYSRLGDLAKQVTAELGGSSVAPSKGLYRVRKSWSDSKSQVGAFSVLENAKRCADSHKGYSVFDERGILVYPRTNKKSIDELAREVIKGLWGNGFDRKNRLTSAGYNYDAVQNRVNELLYGSTKKSIDTIAREVIRGDWGNGTDRKKRLIAAGYDYNAVQRRVNEILS

SEQ ID NO: 1500 - protein, 328 aa, unidentified
  REGION 1..328: note = Lactococcus insecticola
MSISTLASPFGFQSFPHFTAGRSGAKIDKIVIHHMATTNFDSVPSIWQTRQASAHYGIGKNGEIHAYVDENNTAWHAGNWNANISSIGIEHCNSTGSPAWGINQATIDASAKLCADIAKRQGLGQLVPYKNIFPHSHFSATACPGQLLNKLQYIADKANAINNSTPAPIAPSSVLYRVRKTWADVKSQKGAFKDLANAKKCADSNKGYSVFDGNGKSVYTSSTSAPTPQPVKPDLTAIAKQVIAGNFGNGADRKRNLEAKGYNYDQVQAKVNELLGSTPVSKPAVDLNAIADAVIRGDYGNGDTRRQRIIAAGYDYNAVQALVNKKLG

SEQ ID NO: 1501 - protein, 353 aa, unidentified
  REGION 1..353: note = Bittarella massiliensis (ex Durand et al. 2017)
MAMNGIDISNYQRGLDLAKVPCDFIICKATEGTNIVHNTCDPWIQQAKKLGKKWGFYHFLAGGDPIAEADFFVKNCENYFGEGIPVLDYEMYGRKVGTAGAKKFLDRVYEKTKVRCMVYTSRSVLTEENWSAIAPNHALWVAQYPNYNHTGYQSDPWFPAGSIGAFKFVTMHQYTSSGRLPGYNGNLDLDIAYLDRAGWDAIARGDRGGASKPNTPAPAPTPTPSAPAGSTLDLACKVMRGEMGNGADRRKKLGNRYDEVQDFINHINSAGAGTLANEVLAGKYGNGDTRKTVLGSRYNDVQNIVNGRGKKSIDTVAREVIRGEWGNGSARRKKLEAAGYDYDAVQKRVNQLL

SEQ ID NO: 1502 - protein, 306 aa, unidentified
  REGION 1..306: note = Terrabacteria group
MAMKGIDVSTWQGSIDFNRVKQSGINFVIIRAGYGSALSQKDKWFETNYARAKAAGLHVGAYWYSYAGSAGEAREEARICKQVLSGKQFDYPIYFDLEEKSQLARGRAFCDSLIRAFCNEMEAGGYFAGFYTSLSAALNYVSPDVRNRYAFWVAQWNSRCTYGGQYGLWQYSSSGSVPGIAGRCDMDLAYVDYPSIIRKGGFNGYGKGTSSAPARKSVDTLAHEVIAGAWGNGEVRVNRLTKAGYDYDAVQARVNELLGIKPKKSIDTLAREVIRGDWGNGKDRVNRLTKAGYDYEAVQKRVNELL

SEQ ID NO: 1503 - protein, 61 aa, Gardnerella vaginalis
MRALQNKVNELLGVKACRKSVDEIAREVIRGAWGNGNERKQRLTSAGYDYDTVQKRVNELL

SEQ ID NO: 1504 - protein, 218 aa, Abiotrophia defectiva
MTMGQADKLIRVAQSYLGTSQWSDDHLSMVDAYNSVSPIPVGYAVQYGDDWCDIFVTVCGDEAGISQLIGRECGVPRHLAWFQEQGIWLGQAWPQAGDIVIFNFDGGPVDHIGIVERVQADGSISTLEGNYNGRVARAYYDWNHDAIAGYARPRYDQEGQEPAPASLEDTSPSDDLITAVAWDVIRGEYGNGEERIRELTEAGYDYQTVQNRVNQLLS

SEQ ID NO: 1505 - protein, 329 aa, unidentified; identical to SEQ ID NO: 157
  REGION 1..329: note = Peptostreptococcus equinus

SEQ ID NO: 1506 - protein, 335 aa, Alloscardovia omnicolens
MKNWNTVDADIVQLMNRHYTPGRDGESIRFITIHHNAANLTVGGCWQTWQNRPASAHYQVEENGTIGQLVWDRDTAWHAGTWGANIKSIGIEHADKLINGQWQLTQTALDNGAHLVAALCKMYNLGTPQWGINVFPHSRFSSTACPASLQGTQNGEYMRLAQSYYSQMNGGTAVAPTPAEQTSNEKRGRKDNDTIAAEVIQGLWGVGADRANKLSQAGYDYNLIQSLVNQKLGMGTGTSQPVQSVDSIARAVINGEYGNGDERARRLEAAGYDYAVVQAKVNELLGQSNTAAQDLTAIARRVINSEFGNGDTRRARLQAAGYDYQAVQNRVNELV

SEQ ID NO: 1507 - protein, 306 aa, Gardnerella vaginalis
MSKKGIDVSVWQGDIDFNAVKASGVEFVIIRAGYGIGHKDKWFEENYRKAKTAGLDVGAYWYSYASSAGEADLEAQSCVNILSGKSFEYPVYFDLEEKSQLNRGRAFCDSLITSFCNKLEACGYYAGFYTSLSVANNLVSSHVRDRYALWIAQWNTHCSYQGSYGLWQYSSSGSVNGIAGRVDMDYAYVDYPSVIKNAGLNGYQNGGSYTAPQTSSIDEVAREVINGDWGNGNERKNRLTSAGYDYTSVQNKVNELLGVKAYRKSVDELAREVIRGTWGNGSTRKQRLTQAGYDYDAVQKRVNELL

SEQ ID NO: 1508 - protein, 269 aa, Peptoniphilus harei
MSNSPLVQSTIRSPNHSGRRNQKITKIAIHHAAGVINGRNLAGVFVPRSRQASANYNLGSDGVIVLGVDESNRAWTTSSGWCDNQAVTIEVGNSTRGPQWLVSDYVLNRLIDLVTDICRRNGIYPCTYTGGKDGVLQKHEWYSNTNCPGPYLGRKFPYIASEVNKRLRGDKTVSKPTAGLYRVRKSWSDIKSQKGAFKNLENAKRCADRFGLKVFDANGEIVHPVGKTIDQLAREVIRGDWGNGEERKRKLTNAGYDYYAVQKRVNQLL

SEQ ID NO: 1509 - protein, 306 aa, Gardnerella vaginalis
MSKKGIDVSVWQGDIDFNAVKASGVEFVIIRAGYGIGHKDKWFEENYRKAKTAGLDVGSYWYSYASSAGEAALEAQSCVNILSGKSFEYPVYFDLEEKSQLNRGRAFCDSLITSFCNKLEACGYYAGFYTSLSVANNLVSAHVRDRYALWIAQWNTHCSYQGSYGLWQYSSSGSVDGIAGRVDMDYAYVDYPSVIKNAGLNGYQNGGSYTAPQTSSIDEVAREVINGDWGNGNERKNRLISAGYDYASVQNKVNELLGVKAYRKSVDELAREVIRGTWGNGNTRKQRLTQAGYDYNAVQKRVNELL

SEQ ID NO: 1510 - protein, 289 aa, unidentified
  REGION 1..289: note = uncultured Catenibacterium sp.
MAYTNSKMVTYTKLSPNHSGQRTHAIDRITPHCVVGQCSVETLGNIFYPASRQASCQYGIGPDGRVGMYVEEKNRSWCSSSNANDQRAVTIECASDTKHPYTMNSTVYATLIKLCVDICKRNGKKKLIWLGDKNKTLNYSPKSDEMVLTVHRWFANKSCPGDWLYSRLGDLASKVTAQLGGSNSATGNGTSTSGFYRVRKSWSDAKSQKGAFKSLDNAKRCAKANPGYFIFDENGKIVGSDTSSTKTVDELAREVIRGNWGNGTERKNRLTAAGYDYNAVQKRVNELLK

SEQ ID NO: 1511 - protein, 217 aa, Abiotrophia sp.
MGQADKLIRVAQSYLGTSQWSDDHLAMVDAYNSVSPIPVGYAVQYGDDWCDIFVTVCGDEAGISHLIGRECGVPRHLAWFQEQGIWLGQAWPQAGDIVIFNFDGGPVDHIGIVERVQADGSISTLEGNYNGRVARAYYDWNHEAIAGYARPRYDQDSQEQAPASSEEASPSDDLITAVAWDVIRGEYGNGEERVRELTEAGYDYQTVQDRVNQLLKL

SEQ ID NO: 1512 - protein, 218 aa, Abiotrophia sp.
MIMGQADKLIRVAQSYLGTSQWSDDYLAMVDAYNSVSPIPVGYAVQYGDDWCDIFVTVCGDEAGISHLIGRECGVPRHLTWFQEQGIWLGQEWPQAGDIVIFNFDGGPVDHIGIVERVQADGSISTLEGNYNGRVARAYYDWNHEAIAGYARPRYDQEGQESAPASSEDTSPNDDLITAVAWDVIRGEYGNGEERVRELTEAGYDYQTVQNRVNQLLS

SEQ ID NO: 1513 - protein, 88 aa, unidentified
  REGION 1..88: note = Abiotrophia sp. HMSC24B09
MIGRVARAYYDWNHEAIAGYARPRYDQEGQESAPASSEDTTPSDDLITAVAWDVIRGEYGNGEERVRELTEAGYDYQTVQDRVNQLLS

SEQ ID NO: 1514 - protein, 338 aa, unidentified
  REGION 1..338: note = uncultured Clostridium sp.
MSNSSMVSYTRLSPNHSGQRTHSIDRITPHCVVGQLSAESICGCFTSSSVQASCNYGIGTDGRVSLCVEEKNRSWCSSSNANDQRAVTIECASDRSEPYAMNASVYNMLVKLCTDICRRNGKKKLLWFGDKNTSLNYAPKSDEMVLTVHRWFANKSCPGNWLYARMGDLASKVTAALGGASSQSPSTNTGTLYRVRKSWADAKSQKGAFNSLENAKRCANANSGYKVFDGSGNQVYPVLSNTSKSIDAIAREVIQGNWGNGDERKQRLTTAGYDYTAVQARVNEILSGSNTASSKSIDTIAREVIHGDWGNGTDRKQRLAAAGYNYAAVQAKVNEILR

SEQ ID NO: 1515 - protein, 216 aa, Abiotrophia defectiva
MGQADKLIRVAQSYLGTSQWSDDHLAMVDAYNSVSPIPVGYAVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYARPRYDQDSQETAPASSAETSPSDDLITAVAWDVIRGEYGNGEERVRELTEAGYDYQTVQNRVNQLLS

SEQ ID NO: 1516 - protein, 216 aa, unidentified
  REGION 1..216: note = uncultured Abiotrophia sp.
MGQADKLIRVAQSYLGTSQWSDDHLSMVDAYNSVSPIPVGYAVQYGDDWCDIFVTVCGDEAGISHLIGRECGVPRHLAWFQEQGIWLGQEWPQAGDIVIFNFDGGPVDHIGIVERVQADGSISTLEGNYNGRVARAYYDWNHEAIAGYARPRYDQEDKESAPALSEDTTPSDDLITAVAWDVIRGEYGNGEERVRELAEAGYDYQTVQNRVNQLLS

SEQ ID NO: 1517 - protein, 218 aa, unidentified
  REGION 1..218: note = uncultured Abiotrophia sp.
MTMGQADKLISIAQSYLGTSQWSDDHLAMVDAYNSVSPIPVGYAVQYSDDWCDIFVTVCGDEAGISHLIGRECGVPRHLTWFQEQGIWLGQEWPQAGDIVIFNFDGGPVDHIGIVERVQADGSISTLEGNYNGRAARAYYDWNHEAIAGYARPRYDQEGQGPATASSEDTSPSDDLITAVAWDVIRGEYGNGEERVRELTEAGYDYQTVQDRVNQLLS

SEQ ID NO: 1518 - protein, 269 aa, unidentified
  REGION 1..269: note = uncultured Anaerococcus sp.
MSNSSLVQATILSPNHSGRRNQKITKIAIHHAAGVISGRNLARIFVPKSRQASANYNLGSDGIIVLGVDEANRAWTTSSGWCDNQAVTIEVGNSTRGPQWLVSDYVLNRLIELVTDICRRNGIYPCTYTGGKDGVLQKHEWYSNTNCPGPYLGRKFSYIAREVNKRLRGNNTISKSIGGLYRVRKSWSDVKSQKGAFKNLENAKRCADRFGLKVFDANGKIVYPIGKTIDELAREVISGKWGNGEERKRRLTNAGYDYYDVQRRVNQLL

SEQ ID NO: 1519 - protein, 217 aa, Abiotrophia defectiva
MGQADKLISVAQSYLGTSQWSDDHLAMVDAYNSVSPIPVGYAVQYGDDWCDIFVTVCGDEAGISHLIGRECGVPRHLAWFQEQGIWLGQEWPQAGDIVIFNFDGGPVDHIGIVERVQADGSISTLEGNYNGRVARAYYDWNHEAIAGYVRPRYDQEGQESAPASSEDASPSDDLITAVAWDVIRGEYGNGEERVRELTEAGYDYQTVQDRVNQLLKL

SEQ ID NO: 1520 - protein, 226 aa, unidentified
  REGION 1..226: note = uncultured Abiotrophia sp.
MKPQIQQLLANAQAYLGVQGGSPAHQALIDAYNAVDPLPVGYAVTYSDDWCDVFVTVMGDQAGIAHLIGRECGVPRHLTWCQEQGIWLGHVWPQAGDLIFFDFGGGPASHIGIVESVDGDSETVNTIEGNWLNQVVRRHYASDDWRILGYARPRYDARVGSVATSSEAGGANHSNGCADTGGDLDAVALSVIRGDWGNGQERVERLTDAGYDAQVVQELVNEKLAS

SEQ ID NO: 1521 - protein, 216 aa, Abiotrophia defectiva
MGQADKLIRVAQSYLGTSQWSDDHLAMVDAYNSVSPIPVGYQVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYARPRYDQGSQEPAPASSEDTSPNDDLITAVAWDVIRGEYGNGEERVRELTEAGYDYQTVQDRVNQLLS

SEQ ID NO: 1522 - protein, 217 aa, Abiotrophia defectiva
MGQADKLIRVAQSYLGTSQWSDDHLSMVDAYNSVSPIPVGYAVQYSDDWCDIFVTVCGDEAGISHLIGRECGVPRHLAWFQEQGIWLAQAWPQAGDIVIFNFDGGPVDHIGIVERVQADGSISTLEGNYNGRVARAYYDWNHEAIAGYARPRYDQEGQEPAPASSEDTSPSDDLITAVAWDVIRGEYGNGEERVRELTEAGYDYQTVQDRVNQLLKL

SEQ ID NO: 1523 - protein, 216 aa, unidentified
  REGION 1..216: note = uncultured Abiotrophia sp.
MGQADKLIRVAQSYLGTSQWSDDHLAMVDAYNSVSPIPVGYQVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYGRPRYDQEGQEPGPASSEDTSPSDDLITAVAWDVIRGEYGNGEERVRELTEAGYDYQTVQDRVNQLLS

SEQ ID NO: 1524 - protein, 216 aa, Abiotrophia defectiva
MGQADKLIRVAQSYLGTSQWSDDHLAMVDAYNSVSPIPVGYRVQYGDDWCDIFVTVCGDEAGISYLIGRECGVPRHLAWFQEQGIWLGQEWPQAGDIVIFNFDGGPVDHIGIVERVQADGSISTLEGNYNGRVARAYYDWNHEAIAGYARPRYDQEGQEPAPASSEDTSPSDDLITAVAWDVIRGEYGNGEERVRELTEAGYDYQTVQDRVNQLLS

SEQ ID NO: 1525 - protein, 216 aa, Abiotrophia defectiva
MGQADKLIRVAQSYLGTSQWSDDHLAMVDAYNSVSPIPVGYAVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYARPRYDLDGQEAAPASSEDISPSDDLITAVAWDVIRGEYGNGEERVRELTEAGYDYQTVQDRVNQLLS

SEQ ID NO: 1526 - protein, 216 aa, unidentified
  REGION 1..216: note = uncultured Abiotrophia sp.
MGQADKLIRVAQSYLGTSQWSDDHLAMVDAYNSVSPIPVGYAVQYGDDWCDIFVTVCGDEAGLSHLIGRECGVPRHLAWFQEQGIWLGQEWPQAGDIVIFNFDGGPVDHIGIVERVQADGSISTLEGNYNGRVARAYYDWNHEAIAGYARPRYDQDSQEPAPTSSEEASPSDDLITAVAWDVIRGEYGNGEERVRELTEAGYDYQTVQDRVNQLLS

SEQ ID NO: 1527 - protein, 217 aa, Abiotrophia defectiva
MGQADKLIRVAQSYLGTSQWSDDHLAMVDAYNSVSPIPVGYRVQYGDDWCDIFVTVCGDEAGISHLIGRECGVPRHLAWFQEQGIWLAQAWPQAGDIVIFNFDGGPVDHIGIVERVQADGSISTLEGNYNGRVARAYYDWNHEAIAGYARPRYDQEGQEPAPALSEDTSPSDDLITAVAWDVIRGEYGNGEERVRELTEAGYDYQTVQDRVNQLLKL

SEQ ID NO: 1528 - protein, 216 aa, Abiotrophia defectiva
MGQADKLIGVAQSYLGTSQWSDDHLAMVDAYNSVSPIPVGYAVQYSDDWCDIFVTVCGDEAGISHLIGRECGVPRHLAWYQEQGIWLGQEWPQAGDIVIFNFDGGPVDHIGIVERVQADGSISTLEGNYNGRVARAYYDWNHEAIAGYARPRYDQGSQESASASSEDTTPSDDLITAVAWDVIRGEYGNGEERVRELTEAGYDYQTVQDRVNQLLS

SEQ ID NO: 1529 - protein, 49 aa, unidentified
  REGION 1..49: note = uncultured Abiotrophia sp.
MTPSDDLITAVAWDVIRGEYGNGEERVRELTEAGYDYQTVQDRVNQLLS

SEQ ID NO: 1530 - protein, 216 aa, Abiotrophia defectiva
MGQANKLISVAQSYLGTSQWSDDHLAMVDAYNSVSPIPVGYAVHYGDDWCDVFVTVCGDEADISHLIGRECGVPRHLTWFQEQGIWLGQEWPQAGDIVIFNFDGGPVDHIGIVERVQADGSISTLEGNYNGRVARAYYDWNHEAIAGYARPRYDQGSQETAPASSEDASPSDDLITAVAWDVIRGEYGNGEERVRELTEAGYDYQTVQDRVNQLLS

SEQ ID NO: 1531 - protein, 269 aa, unidentified
  REGION 1..269: note = Peptoniphilus rhinitidis
MSNSPLVQATILSPNHSGRRNQKITKIAIHHAAGVINGRNLAGVFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIANEVNKRLRGDKTVSKPTCGLYRVRKSWSDVKSQKGAFKNLDNAKRCADRFRLKVFDSNGKIVYPVGKTIDQLAREVIRGDWGNGDERKRRLTQAGYDYFAIQKRVNQLL

SEQ ID NO: 1532 - protein, 328 aa, Anaerococcus vaginalis
MSNSSLVSIVNYSPNHSGRRNQPITKIAIHHTAGAVSAATIGQIFKPTSRQASCNYGIGNDNKVVLCVDESNRSWCTSSSWCDNRAITIEVSNSSNGGNWPVSDRVIAKLIDLVTDICKRNGIKNCTYTGGKDGVLQKHEWYANTNCPGPYLGSKFPYIASEVNKRLAGGSSNAPSTGGSSLYRVRKSWSDAKSQKGAFKNLDNAKKCANANPGYSVYDANGNVVYPIASAPSKSVDTLAREVLAGNWGNGQDRVNRLTSAGYDYNAVQNRVNEILSGSASKPTGKSIDTLAREVIQGQWGNGQDRINRLERAGYDYNAVQRRVNELL

SEQ ID NO: 1533 - protein, 326 aa, Anaerococcus vaginalis
MSNSPLVQATILSPNHSGRRNQKITKIAIHHAAGVISGRNLAGVFVPKSRRASANYNLGSDGVIVLGVDESNRAWTTSSGWCDNRAVTIEVGNSTRGPQWLVSDYVLNRLIDLVTDICRRNGIYPCTYTGGKGGVLQKHEWYSNTNCPGPYLGSKFPYIANEVNKRLRCNKTVSRPAGGLYRVRKSWSDVKSQKGAFKNLDNAKKCVNANPGYAVYDVNGRSVYPVASAPSKSVDTLAREVIAGNWGNGQDRVNRLTSAGYNYNSVQNRVNEILSGVSNKPSGKSIDTLAREVIRGDWGNGQDRKNRLERTGYDYDAAQKRVNELL

SEQ ID NO: 1534 - protein, 269 aa, unidentified
  REGION 1..269: note = Peptoniphilus
MSNSSLIQATILSPNHSGRRNQKITKIAIHHAAGVISGRNLARIFVPKSRQASANYSLGSDGIIVLGVDEANRAWTTSSGWCDNQAVTIEVGNSTRGPQWLVSDYVLNRLIDLVTDICRRNGIYPCTYTGGKDGVLQKHEWYSNTNCPGPYLGSKFPYIASEVNKRLRGDKTFSKPKSGLYRVRKSWSDVKSQKGAFKNLDNAKRCADRFGLKVFDANGKIVYPVGKTIDELAREVINGKWGNGKERKRRLTNAGYDYYDVQRRVNQLL

SEQ ID NO: 1535 - protein, 306 aa, unidentified
  REGION 1..306: note = Actinotignum urinale
MAIKGIDVSTWQGSIDFKRVKQSGINFVIIRAGYGSALSQKDKWFETNYARAKAAGLHVGAYWYSYAGSAGEAREEARVCKQVLSGKQFDYPIYFDLEEKSQLARGRAFCDSLIRAFCNEMEAGGYFAGFYTSLSAALNYVSPDVRNRYAFWVAQWNSRCTYQGQYGLWQYSSSGSVPGIAGRCDMDLAYVDYPSIIRKGGFNGYGKGTSSAPARKSVDTLAHEVIAGAWGNGEDRLNRLTKTGYDYDAVQARVNELLGIKPKKSIDTLAREVIRGDWGNGKDRVNRLTKAGYDYEAVQKRVNELL

SEQ ID NO: 1536 - protein, 93 aa, Streptococcus anginosus
MDTLAREVIAGNWGNGSDRVNRLRAAGYDYDTVQNRVNAILSGSASKPSGKSIDTLTREVIRGDWGNGQDRKNRLERAGYDYNAVQRRVNELL

SEQ ID NO: 1537 - protein, 216 aa, Abiotrophia defectiva
MGQADKLIRVAQSYLGTSQWSDDHLAMVDAYNSVSPIPVGYAVQYSDDWCDIFVTVCGDEAGISHLIGRECGVPRHLAWFQEQGIWLGQEWPQAGDIVIFNFDGGPVDHIGIVERVQADGSISTLEGNYNGRVARAYYDWNHEAIAGYARPRYDQDNQESAPASSEDTSPSDDLITAVAWDVIRGEYGNGEERVRELTDAGYDYQTVQDRVNQLLN

SEQ ID NO: 1538 - protein, 330 aa, unidentified
  REGION 1..330: note = Microbacterium phage Golden
MVFSPLTARTVAHHGKHRGSDPKKTRIIVHHWAGTSGGDTALMKPKGQNSRGDVSASYILYNDGTLVGQVPEELSPWTTGSADWGSVTVETQNKRGAPNWDIDSRAKEKLAQLMADLSDRYGWGALRLGTNVRMHREFNATACPGPDMVASLPSIVARANQLRKGGGGSTPTPGGTYTVAKGDTLSGIASKYGTTWQELQKLNGLADPNKIFPGQKIKVPSGGGSTPNKPSQSLADVAKAVIRGDYGNGSTRVAKLRAAGYDPAEVQAEVNRQLYGGGSKTPVASNVDAVARQVIRGDWGNDPERKKRLTAAGYDYSAVQRRVNEILAGK

SEQ ID NO: 1539 - protein, 331 aa, unidentified
  REGION 1..331: note = Microbacterium phage Koji
MAKFSSLINGTTPDHGKNRGKDPNKKRIIVHHWAGTAGGDTALMKPKGQNSRGDVSASYILYSDGRLIGQVSEEFSPWTTGSADWGSVTVETQNAANGGNWPIDARAKEKLAQLMADLSDRYGWGELRLGTNVRYHGEFYATACPGPDMIASLPSIVKRANQLRKGGGGSQPSTGGTYTVVKGDTLSGIASKHGTTWQELQRLNGLADPNKIFPGQKIKVPSGGGSTPSKPSQSLADVAKAVIRGDYGNGQDRVNRLRAAGYDPAEVQREVNRQLYGSGSKTPVASNVDAVARQVIRGDWGNDPERKKRLTAAGYDYSAVQRRVNEILAGK

SEQ ID NO: 1540 - protein, 161 aa, unidentified
  REGION 1..161: note = uncultured Ethanoligenens sp.
NHSDVMHWFPKHGKSMDTFRTEVKRLLTADGSSAAPTTAKTVDELAREVIRGDWGNGAERKSRLTAAGYDYAAVQVRVNEILNGNTKPDPSMKSTWWLKATPFGRFHRRSLVAAPGYTEIKSLNGLSSDTIYTGQKLKIPKSTDDSMPLQTALAVVWMVRI

SEQ ID NO: 1541 - protein, 317 aa, unidentified
  REGION 1..317: note = Oscillospiraceae bacterium
MTITQRNSPNHRVGRQGHTPDFIVCHTTGGSFTSAINTIMNSANQVSYHYVVARDGAVTQLVRLIDTAWHAGTTNNGGNADNRHSTIATVRDRQVNANLYTVGIGFADMANGNASPQQVDTAVALISHIRDEVRRIYDFEIPMTRTNIIGHNETTPRTRAFCPGVNFPFNEIIRRISEQHAARPAIPPTPSAIAAGDVVRLTDSATYYDGRTIPAWVRNENWIVSAIWGDRAVIDKSQSGAHAIKSPVNVRHLTVVGSDAISTQVPEPATTHRPLDDIAHEVIRGNWGNGTERRQQLTAAGYDAAAVQRRVNEMLRA

SEQ ID NO: 1542 - protein, 86 aa, unidentified
  REGION 1..86: note = Lachnospiraceae bacterium
MRACDLIRQDGWATSLKYSENLKSLIRKYGLTEYDRKAVGGNKDIDAVARDVIDGKYGNGEERKQRLKAAGYDPAEVQRKVNEMLK

SEQ ID NO: 1543 - protein, 130 aa, unidentified
  REGION 1..130: note = uncultured Granulicatella sp.
MSKDNDRTLLVSHMVIEGEFGNGEERVKRLTEAGYDATEVQNEVNRILAEENGESNEVTNNETMQQKYKSGGNLLSGSRESNSYRDLDIDSIATEVIQGDWGNGEERRERLEQAGYDYDAVQARVNKMLE

SEQ ID NO: 1544 - protein, 129 aa, Abiotrophia defectiva
MTTARFSDSDNSHIGIVESVDGDSETVNTIEGNWLNQVVRRHYASDDWRILGYARPRYDARAGSVATSSEAGGANRPNGCADIASDLDAVALSVIRGDWGNGQERVERLTDAGYDAQVVQELVNEKLAG

SEQ ID NO: 1545 - protein, 213 aa, unidentified
  REGION 1..213: note = Muribaculaceae bacterium
MADKNKFQLNKGAGHTFDMSKGGKRKFDLSKDDEESVAAPNPAPAAPVAPATQGTATVSGAADSTDKSNNKWLWLILAIIAVVLLVWWLYPGNDSDSQSAEDVTTEVVVPTDSLNEEAAEEPALPADENVSADDAANDENASIATTDAATEPVETPAQAVAVADNNVSDDVEAEALKVIRGEYGIGQERKNRLGDRYGAIQNRVNQLKQEGVF

SEQ ID NO: 1546 - protein, 201 aa, unidentified
  REGION 1..201: note = Segatella copri
MADNKKQRKSTRSFNMEKHVERHFDIEKEQVPVLDTPQNKTIDVQTQETDGGNNGNGSKNKILAIIAVIVLIVVAFVAYRSCGTNESKVDELTNTIVSDSTEKEKADTTSNEEKSASPISEQSQSTSSEVSSETGTNAESDNTSAVPTTKSESSGKSIEEKAMQVWDGVYGNGTERKSKLGSDYKAVQKRVNEMYRNGYRH

SEQ ID NO: 1547 - protein, 247 aa, unidentified
  REGION 1..247: note = Prevotella jejuni
MRYQASQLYATTNMVEIKRKVTLRTKTSQPEEKPTTEVTPEVQSSASQQEPTPTPPPPTEPTTNAEGSKRGGNWKQWLAAFVLAALLRGGYYLYNNSQGNDVQDTTTVAKTDSTDTQKDSTQTAQADSTTKVKPEADGNNVATETANETAAEDNSVSETTTPSNNTSANNTTANTTTDQQTASTDNLGTSSNTEPTAAEPANSVQETAKDVIRGTYGNGVTRRHKLGSRYEEVQKRVNEMYRQGLIR

SEQ ID NO: 1548 - protein, 208 aa, unidentified
  REGION 1..208: note = Caudoviricetes sp.
MIRPDYRDIRIRSQFLQHSSEGSSWKNHKYIKRVDGTYYYPDSYEGGRHLPDGEKYKIMEDELFEKLKNSSDKDIGQMLSGSFDKVLLEQMGVDWTKLPKEEVDRMQRNLIDRFEEKTESNSKIDLSENDIENLAKEVIRGNFGNGQERKDLLGENYEEIQKRVNELMKGSAGSKTIPSDKTKDIGIAEEAAKRAVALVETDRNKKTK

SEQ ID NO: 1549 - protein, 208 aa, unidentified
  REGION 1..208: note = Caudoviricetes sp.
MIRPDYRDIRIRSQFLQHSSKGSSWKKHKYIKRVDGTYYYPDSYEGGRHLPDGEKYKSMEDELFEKLKNSSDKDIGQKLRGSFDKVLLEQMGVDWTKLPKEEVDQMQRNLIDRFEEKTESNSKIDLSENDIENLAKEVIRGNFGNGQERKDLLGENYEEIQKRVNELIKGTAGTKTIPSDKTKDISIAEEAAKRAVALVETDRNKKTK

SEQ ID NO: 1550 - protein, 283 aa, unidentified
  REGION 1..283: note = Caudoviricetes sp.
MEMRTSKPSAGNKFYNTTSRGGYSQCIQGSPTDAGCNVLANCVGYACGRFNEIIGSMKYPYLNCNAENFIERAKKCGLTVVSYPTLGGIMVWQKGATLSGNDGAGHVAVVERIDGANKILTSESGYGSRTAFWNSVRTNSNGRWGLGSGYTFRGCIVNPAIGDVHYVEPVPTPTPSKSNEEIANEVIQGKWGNNPERKQRLTDAGYDYNAIQEIVNNKMASNTPASNSSNDELLTLVKKTIRGDFGNGADRRKALGSNYDEVQRQVNLNLQNGLTRWDNIKLF

SEQ ID NO: 1551 - protein, 315 aa, unidentified
  REGION 1..315: note = Bacteriophage sp.
MNGIDISKWQAGIDLSKVPCDFVIVKATENLGYVNHDFKRAMEQGLAAGKRMGVYHYAGGRDPILEAKHFLRIAEPYIGKAILCLDWERTYNISFGFNDVAWCRRWLDYVRGVTGVTPFLYISAGFRDKFDGILEDEHDFEQTLAKFAELTNENHLWAAQYANEKRVDGYIEHPWNEGKYQCDIRQYTNQLHLPGWNDRLDGNKSYLTAEEWDACAKPIADEPEEPKDMPTIDELARDVLDGKWGNGDERRKRLEEAGYDYDEVQARVNAIVADEEITRLAQKAIHGDFGNGAERKRKLGDKYQAVQERVNEIYR

SEQ ID NO: 1552 - protein, 347 aa, unidentified
  REGION 1..347: note = Candidatus Coprousia avicola
MSSILPTIADVSSWQGGIAWATVKPNVHFAIIRVQDGTYLDNRLADNIKGCEAQGIPYYLYGFYRNGGAVEAARMVSRAKAAGATKQRGYVLDVEVSGQSTANIKSAMATLNASGLDNGLYIANHLYSEYGGEDYGEKWRWIPTYGVNDGRAHTPPKHYCDLWQFTSAGKVPGISGNVDCNALNGNRTLASFTTDAVSGKPTGGDVAGDTTLDLTRSAAELVGDVLAGDAGNGDVRKTKLGSRYGEIQALVNHVLTASASALAQEVIDGEWGNGETRKRAMGARYDEVQEKVNAKLGASPAKTYTVKSGDTLSEIGAELGVSWKDIAANNGISAPYTIYPGQQLVVE

SEQ ID NO: 1553 - protein, 182 aa, unidentified
  REGION 1..182: note = Bacteroidaceae bacterium
MANNFFTSEDFDKIEPPSKKKNYIIGGVVAVAAVVAALFMFGSSEESNTAKEIPDTVTKSYTALQKQTVHTDDKQNTENVQQIGITDISGVNTTKPQNAAIEKNISNEKQTATVVKPEKESVKKTEEQVKMNTLAPETVEKKALEVIRGNYGNNPVRRERLGSNYKVIQSRVNEMYREGQVW

SEQ ID NO: 1554 - protein, 283 aa, unidentified
  REGION 1..283: note = Mollicutes bacterium
MEMRTSKPSAGNKFYNTTSRGGYSQCIQGSPTDAGCNVLANCVGYACGRFNEIIGSMKYRYLNCNAENFIERAKKCGLTVVSYPTLGGIMVWQKGATLSGNDGAGHVAVVERIDGANKILTSESGYGSRTAFWNSVRTNSNGRWGLGSGYTFRGCIVNPAIGDVHYVEPVPTPTPSKSNEDIANEVIQGKWGNNPERKQRLTDAGYDYNAIQEIVNNKMASNAPTSNSSNDELLTLVKKTIRGDFGNGADRRKALGSNYDEVQRQVNLNLQNGLTRWDNIKLF

SEQ ID NO: 1555 - protein, 232 aa, unidentified
  REGION 1..232: note = Bacteroidales bacterium
MGNDKKSSRSFNLDKGSKRSFDLEKKPTRSFDLTKEEATANTPPPTNQANARNSANTAHTSSTPLNGSGDAGTSKKKWLWIALAVLILAIIAYILIPHGNTTTPPTVGDSTEVVSGDSSTTEPADSVLKDSTAAATNPTGSTIENNSESEPNTETQPTTMQSANTPSASTHPENADNTAISEPSNAPTLTGNIEDQAHQVIRGVYGNNPERRQKLGAEYKAIQKRVNELMRQ

SEQ ID NO: 1556 - protein, 245 aa, unidentified
  REGION 1..245: note = Muribaculaceae bacterium
MAKKNNERIDLSKSGDELLKDMENGATDAQAVATSEETDAQPVAPGEGDKTPKPVIPVEGVNPPQPEVPASVQEPDLSKEATDKAIEYGPEEPKKKGFAWLWALIGIAIVLAFLGWTFLKKGDKTDADAPEQTEEAVAVTDSASDDSVATLPSEGNSDEAVASEAENSNGSNAVQDNTVTANASQASVAEDADPVASIPGGDVEAEAMKVIRGEYGNNPVRRNNLGSKYQEIQNRVNELKRTGKF

SEQ ID NO: 1557 - protein, 268 aa, unidentified
  REGION 1..268: note = Muribaculaceae bacterium
MAKKNNERIDLSKSDDELLKDVENGATGVQTVAPSEETGAQPGVAGEGDELVKPVIPVEGVNPPQPEVPASVLEPDLSEEATDKAIEFGPEEPKKKGFAWLWTLIGIAIVLAFLGWTFLKKGDKTDANAPEQTEETVPVADSANDDSVASLPSEGSSDEAVASEAENSTNGAENGAEGGAAMDEGKVSANSSVANAGKDNTVTANASQPSTAEATVPSTSIQGSDVEAEAMKVIRGEYGNNPVRRNNLGSKYQEIQNRVNELKRTGKF

SEQ ID NO: 1558 - protein, 232 aa, unidentified
  REGION 1..232: note = Alloprevotella sp.
MGNDKKSSRSFNLDKGSKRSFDLEKKPTRSFDLTKEEATANTPPPTNQANAHNSANTAHTSSTPLNGSGDAGTSKKKWLWIALAVLILAIIAYILIPHGNTTTPPTVGDSTEVVSGDSATTEPADSVLKDSTAAATNPTGSTIENNSESEPNTETQPTTTQSANTPSASTHPENADNTAISEPSNAPTLTGNIEDQAHQVIRGVYGNNPERRQKLGAEYKAIQKRVNELMRQ

SEQ ID NO: 1559 - protein, 283 aa, unidentified
  REGION 1..283: note = Bacilli bacterium
MEMRTSKPSAGNKFYNTTSRGGYSQCIQGSPTDTGCNVLANCVGYACGRFNEIIGSMKYPYLNCNAENFIERAKKCGLTVVSYPTLGGIMVWQKGATLSGNDGAGHVAVVERIDGANKILTSESGYGSRTAFWNSVRTNSNGRWGLGSGYTFRGCIVNPAIGDVHYVEPVPTPTPSKSNEDIANEVIQGKWGNNPERKQRLTDAGYDYNAIQEIVNNKMASNTPASNSSNDELLTLVKKTIRGDFGNGADRRKALGSNYDEVQRQVNLNLQNGLTRWDNIKLF

SEQ ID NO: 1560 - protein, 205 aa, unidentified
  REGION 1..205: note = Porphyromonas uenonis
MAPHQDKVTLKRKVTLREKQPSATPTPSDQAPKSSRPKVWILVIVIVALIGCGYFLFNNRDAQPTESTELVAATEVSPSDSPAGEQASSQDADGEATPELPDAPQSTEAQQDSEAPASAATATEPAKEHPVSTESKPAQDASTATATETRASASATVDPNKSIDEVARDVIRGLYGNGTTRKANLGSRYAEIQKRVNEMYQSLPR

SEQ ID NO: 1561 - protein, 234 aa, unidentified
  REGION 1..234: note = Prevotella sp. C561
MVEIKRKVTLRTKTSQPEEKPATEVTPEVQLSASQQEPTPTPPPPTEPTTNAKGSKGGGKWKEWLAAFVLASLLLGGYHLYNNSQGNDAQHTTTVAKTDSTDTQKDSTQTAQADSTTKVKPEADGNNVATETANETAAEGSSVSKTTIPSSNTSANNTTANTTTDQQTASTDNLGTSSTTEPTAAEPANSVQETAKDVIRGTYGNGVTRRHKLGSRYEEVQKRVNEMYRQGLIR

SEQ ID NO: 1562 - protein, 414 aa, unidentified
  REGION 1..414: note = Bifidobacterium sp. A11
MRWSHARHARAKPRYARIMVGALAVLAMLTPGAAYADAGFDNASYQGCYNAQAARDSGASFSITKITEGTGYVNPAADCQLAANRAAGLRLGAYAYARPDYGNSPEAEADHFNAQANARGLVHAGVIPFLDWEPPAPYNSHTDWAKRWLDRVASYWGTKPIIYMQASNIQAGDWNAVAGADYGLWVAGYPRGYVGERLRDPGAPPYSVAPWHFAAAWQYSSSGHVPGVGTAVDVNWFYGDSVTWAKYANAPVGTQPNPVAPSPTPKEGAPVGDASSIATAVIRGEYGNDPQRHALLGSRYDEVMAVVNERLRGNSGGGNGSGIYVVRPGDCLSMVFGGSWPVIARLNGIRAPYVIYPGQRLATDHGGGGGRTVTVQRGDTLSGIAARLGIAQSQIHGYRSGNPSLIYAGETLHY

SEQ ID NO: 1563 - protein, 343 aa, unidentified
  REGION 1..343: note = Abyssicoccus albus
MVSIERKLVTNKFSRPRSKMATVKGVIVHWTANAGATADNHYRFFEHNNTRYAGAHYFVDKNKIVQLIPENETTYHANESGYSKVGKFDGYKSSDGYRGNANSCTIGVEMCVESNGTIHANTIKQTIELIKDINRRHNLSVNDVYRHFDVTGKLCPKPFVNDQLAYQNFKRALGQRTATTRKVVKQAKPIKVKGTSIVDWLNAHGQDSSFASRSKLAREYGIANYRGTASQNVKLLKLIRKGVPRKASVNIDKMAQDVIDGKYGSGVQRRKALGSYYSRVQKRVNEIFSSRKTTKKTASKSISQMASEVLAGNHGIGHANRQRSLGVDNATYHRVRAEVNRRS

SEQ ID NO: 1564 - protein, 234 aa, unidentified
  REGION 1..234: note = Prevotella jejuni
MVEIKRKVTLRTKTSQPEEKPTTEVTPEVQSSASQQEPTPTPPPPTEPTTNAEGSKRGGNWKQWLAAFVLAALLRGGYYLYNNSQGNDVQDTTTVAKTDSTDTQKDSTQTAQADSTTKVKPEADGNNVATETANETAAEDNSVSETTTPSNNTSANNTTANTTTDQQTASTDNLGTSSNTEPTAAEPANSVQETAKDVIRGTYGNGVTRRHKLGSRYEEVQKRVNEMYRQGLIR

SEQ ID NO: 1565 - protein, 306 aa, unidentified
  REGION 1..306: note = Alloscardovia theropitheci
MALNGIDISNWQANIDLTKISFDFVIAKATQGTHYVSPSCDKQIQQAKTLGKLYGVYHYAEGTDPTAEANYFLTNIQGYLHQALLVLDFEAGENNAWNNNPNTWIKTFCDHITNQTGIKPLIYIQASALAKVANVGDYGLWIAQYANNDPTGYQATPWNEGAYNCAMRQYSSNGRFTGYNGPLDVNKFYGDATAWNKYANPTGAATTSPQATTAPTVDIEQLARDVIAGKYGDGDARRNALGANYDTVQARVNQIVGTQKTYHTVSRGETLSGIAARYGTSWQKLARINSLSNPNLIHPGQTLLIQ

SEQ ID NO: 1566 - protein, 413 aa, unidentified
  REGION 1..413: note = Bifidobacterium polysaccharolyticum
MQWFHARHARAKPRYGQIMVGAMVALAMLSPGVAYADAGFDNASYQGCYDAQKAKESGASFSITKITEGTGYVNPSADCQLAANKAAGLRVGAYGYARPEYGNSPEAEADYFNAQSNAKGLVHAGVIPFLDWEPPASQRGDTQWAKRWLDRVASYWGTKPIIYMSASTISVGDWRAVAGADYGLWVAGYPRGYKGERLRDPGAPPYSVAPWPFAAAWQYSSSGHVPGVGTAVDVNWWYGDAGTWAKYANARVGTQPNPVSPAPTPAQGAPVGDTASIATAVIRGEYGNDPQRRVLLGNRYDEVMAVVNERLRGNSGGGGSGTYVVRPGDCLSAVFGGSWPMVARLNGISPPYVIHPGQRLATGHGGGGGRTVTVQRGDTLSGIAARLGIPQNRLNGYRSGNPSLIYVGEVLNY

SEQ ID NO: 1567 - protein, 615 aa, unidentified
  REGION 1..615: note = Bifidobacterium sp. ESL0745
MPFHGGKRHQGDQDDSTSTDRASVGRRTRQRGEFSRSTNIATTSIPESRSIKICNKETHRSGHKYRNNNNQQEKGNTMSKHTPQHALRTPRTRSRAGLLTTTGLAAIALSVMAPSANAAVLNNDGSVTIQPGDTLSQIATDYGSKDGRWGYWKGFTSGDDDLIYPNEVVGDSRRMDTSGLEAKSRAALKKGAVPTASVTTDDVDQLAHEVMLGAYGNGEARREALGDKYDAVQVRVNQLMGYGVVAAANATNSVNAPASNAASRPMTHPSQAYGPVPSAPAPAIPAPAPAAPAPAAPVASTPSTPAPAPSTPSQPSTRSQPSQPSMPSAPSTPSHPSTPSTPSQPSQPSIPSHPSTPSTPSHPSVTPHDIVHPAGSEGTYDHKPSPAWTEHIRVDENGNMVDDVSERPYWVAGTPATPGTPATTHVVHHDAVPGSSVNENGTPVWGDWGTAGYSQTVTGRIYTSKLDGFQVKDWSGTDPQGKDYAFVAGADMTMDFHNMSLPQAVWDAHPGLEAAHAADYHNAFTVTTVNVPQWIATPDNVGKRKIAYFTYSDGFHTPVANPNVYYNPATGIDTAGETWHDVEGYPTHVVNKPGTAAYDEVVTDAPAVPGTWKTR

SEQ ID NO: 1568 - protein, 209 aa, unidentified
  REGION 1..209: note = uncultured Porphyromonas sp.
MAPHQDKVTLKHKVTLRKKQHSATPTSPEQAPKSSRRKVWILVIVIVALIGGGYLLFNNRDAQPTESTELVAATEVSPSDSPAGEQASSLDADGDAAPELPDAPQSTEAQQDSEAPASAAVASEPAEGQTEKQTASTESKPAQGASTATTAEPRASASATVDPNKSIDEVALDVIRGLYGNGTTRKANLGSRYAEIQKRVNEMYQSQPR

SEQ ID NO: 1569 - protein, 209 aa, Porphyromonas sp.
MAPHQDKVTLKRKVTLREKQHSATPTPPEQAPKSSRRKVWILVIVIVALIGGGYLLFNNRDAQPTESTELVAATEVSPSDSPAGEQASSLDADGEAALELPDAPQSTEAQQDSEASASATTVSEPAKEPAEKQTVSTESKPAQDASTATIAETRASASATVDPNKSIDEVALDVIRGLYGNGTTRKANLGSRYAEIQKRVNEMYQSLPR

SEQ ID NO: 1570 - protein, 209 aa, unidentified
  REGION 1..209: note = uncultured Porphyromonas sp.
MAPHQDKVTLKRKVTLREKQPNATPTPPEQAPKSSRPKVWILVIVIVALIGGGYLLFNNRDAQPTESTELVAATEVSPSDSPAGEQASSLDADGEAAPELPDAPQSTEAQQDSEASASATTVSEPAKEPTEKQTASTESKPAQDASTATIAEPRASASATVDPNKSIDEVALDVIRGLYGNGTTRKANLGSRYAEIQKRVNEMYQSLPR

SEQ ID NO: 1571 - protein, 218 aa, unidentified
  REGION 1..218: note = uncultured Duncaniella sp.
MSEQGKSKFQLNKGTDRGFDISKGRKRKFDLTKDGDRHVVAPTTEPQTAAPVNQVDPSTEPEKKNNSVWLGVILAIIAVILLAWWLLPGKSTEAEPIGEEETIEVVTTPAENTGEVSNEAENQNVEDAVEENTDYGESSNPSSAVVNTPATTPADTQTTDNVAINNASSSVVSNNVEAEALKVIRGEYGIGQERKNKLGNQYESIQRRVNELKREGAF

SEQ ID NO: 1572 - protein, 209 aa, Porphyromonas sp.
MAPHQDKVTLKHKVTLRKKQNSATPTPSDQAPKSSRRKVWILVIVIVALIGGGYLLFNNRDAQPTESTELVAATEVSPSDSPAEEQASSLDADGEATPELPDAPQSTETQQDSEAPAAAAAASEPAKEQTEKQTASTESKPAQDASIATIAEPRASASATVDPNKSIDEVALDVIRGLYGNGTTRKANLGSRYAEIQKRVNEMYQSLPR

SEQ ID NO: 1573 - protein, 209 aa, Porphyromonas sp.
MAPHQDKVTLKHKVTLRKKQNSATPTPSDQAPKSSRRKVWILVIVIVALIGGGYLLFNNRDAQPTESTELVAATEVSPSDSPAGEQASSLDADGDAAPELPDAPQSTEAQQDSEAPASAAVASEPAEGQTEKQTASTESKPAQDASIATIAEPRASASATVDPNKSIDEVALDVIRGLYGNGTTRKANLGSRYAEIQKRVNEMYQSLPR

SEQ ID NO: 1574 - protein, 234 aa, unidentified
  REGION 1..234: note = Prevotella jejuni
MVEIKRKVTLRTKTAQPEEKPATEVTPEVQSSTSQQEPTPTPPPPTEPTTNVEGSKGGGNGKKWLAAAVLVVLLGGGYYLFSNSQGSDAQNTTTVAKTDSADAQKDSTQTVQADSTTKVKPEADGNNVATETANETAAEGSSVSKATTPSSNTSANNTTANTTTDQQTASTDNLGTSSNTDPTAAEPANSVQETAKDVIRGTYGNGVTRRHKLGSRYEEVQKRVNEMYRQGLIR

SEQ ID NO: 1575 - protein, 227 aa, unidentified
  REGION 1..227: note = Streptococcus pyogenes MGAS15009 MGAS15009
MTVDTEKAIAWMGLKEGRVSYSMDYRNGPDSYDCSSAICSALIYAGASNPGWLLNTEYMHDWLVQNGFELIAENEDWDSQRADIAIWGLRGQSAGAGGHVVMFIDADNIIHCNYANNNITIDNYNQTAAASGWMYSYAYRYNGEQSQPTNKSIDELAQEVLAGKHGSGEQRKLSLGSNYDAVQAKVNEMLKQPQVAEQSPAVKQDGDLLFNGAVLKKAILDKILAKC

SEQ ID NO: 1576 - protein, 450 aa, Streptococcus pyogenes
MTINIETAIAWMAARAGKVTYSMDYRNGPSSYDCSSSVYYALMSAGAISAGWAVNTEYEHDWLIKNGYKLIAENQDWDSKRGDIFIWGIRGQSSDSGGHTGIFIDPDNIIHCNYANNSITINNYNQTAADNGWMYSYVYRLANQNSTPSTSDKTIDTLVKETLAGKYGNGDQRKAALGNQYEAVMAVINGKATTAQKSIDELAQEVLAGKHGSGEQRKLSLGSNYDAVQAKVNEMLKQPQVAEQSPAVKQDGDLLFNGAVLKKAILDKILAKCKEHDILPSYAITVLHFEGLWGTSAVGKTDNNWGGMTWIGKGERPSGVTVTQGTARPSNEGGYYMHYSSVDDFLTDWFYLLRSGGSYKVSGAKTFSEAVKGMFKVGGAVYDYAASGYDNYLVGMSSRLKSIETENGSLSKFDVATVENVGSKDKIEVNIDGIEISINGITYTISKKPV

SEQ ID NO: 1577 - protein, 336 aa, unidentified
  REGION 1..336: note = Candidatus Saccharibacteria bacterium
MARSRQEVRDFLNSLVGQRVNAKAGIYNGQCVSLIKALLEFLGVDNPYGARGNAKDVGDTLLRQGIAANGPGWLQVVVNRDMGVIDGVRYGHIWLDLSGEANFEQNGARALLTTKGTRPLSQGQQIVNLDKYVKADPVAPTKKSNDEIASEVLAGKWGNNPDRAKKLYAAGYDAGAIQAIVNARTGQAPSAPRKSNEVIAAEVLAGAWGNGDDRKNRLQGAGYDYNAIQAIVNAKTQPARLSNEQVADQVIAGAWGNGDERRTRLAQAGYDYNAVQAAVNAKLPKAATPTRKSNEQVANEIIAGQWGKGQERKNRLAAAGYDFGAVQAIVNRKLGF

SEQ ID NO: 1578 - protein, 196 aa, unidentified
  REGION 1..196: note = Muribaculaceae bacterium
MANDKKKRTFNLDKGEKRTFNLAKEDDEEIDVVVPEQQPEPPESLTGQIEEDSGMDQPKKPNRKGVYAILAVCVLAAIGLLIWWLIPSDRTETLEPDSEGIADTATAPADTAREPENTIPQDAAPADEASPSASENIPAQENTPATSAPAEAPSGSIDEQAQKAIQGVYGNGRTRRDNLGSTYREVQDRVNELLKK

SEQ ID NO: 1579 - protein, 309 aa, Clostridium sp.
MKKFGIDVSEFQGVIDWEKAKKGGVEFAILRCGFGQNTTKQDDKQFARNASECERLGIPYGVYLYSYATDVIKAKSEADHVLRLIKGKKLVYPVFYDLEDAATAKCSKIVIGDMAEVFCNAVSDAGYKVGIYANTSWFNNILTDSRFDKWDKWVAQYYKECQYGKPYIGWQYSSTTKVDGINTNCDVNYFYKDYAEEKQTGAVGVLENAGIHELEIKKDTASVAKEVLSGKWGNGADRKARLTRAGYDYDAVQTEVNRLLAKNNVKTIDELAREVIQGKWGNGKDRVDRLTKAGYNYDEVQKRVNTLCG

SEQ ID NO: 1580 - protein, 412 aa, Bifidobacterium breve
MDIKNKSKPSLVMRILAVVVAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1581 - protein, 449 aa, Streptococcus dysgalactiae
MAIETEKAISWMVARQGAVSYSMDYRNGPSSYDCSSAIYYALMSAGTISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGIYGNGDTRKSALGNQYEAVMAVINGKATTTQKSIDELAQEVLAGKHGSGEQRKLSLGSNYDAVQAKVNEMLKQPQVAEQSPAVKQDGDLLFNGAVLKKAILDKILAKCKEHDILPSYAITVLHFEGLWGTSAVGKADNNWGGMTWTGKGERPSGVTVTQGTARPASEGGNYMHYASVDDFLTDWFYLLSADGSYKVSGAKTFSEAVKGMFKVGGAVYDYAASGYDNYIVGMASRLKAIEQENGPLNKYDKQTDISVGQSDKIDVVIDSLEITINGVTYTSTKKPV

SEQ ID NO: 1582 - protein, 405 aa, Streptococcus dysgalactiae
MTVDTEKAIAWMGLKEGRVSYSMDYRNGPDSYDCSSAICSALIYAGASNPGWLLNTEYMHDWLVQNGYELIAENEGWESQRADIAIWGLRGQSDGAGGHVVMFIDADNIIHCNYARNNITIDNYNQTAAASGWMYSYAYRYNGEQSQPITNKSIDELAQEVLAGKHGSGEQRKLSLGSNYDAVQAKVNEMLKQPQVAEQSPAVKQDGDLLFNGAVLKKTVLDKILAKCKEHDILPSYAITVLHFEGLWGRSAVGRSDNNWGGMTWTGKGERPSGITVTKGTARPVSEGGHYMHYSSVDDFLTDWFYLLRAGGSYKVSGAKTFSEAVKGMFIVGGAKYDYAASGYNNYIVGMSSRLKAIEQENGPINKYDQQADISAEQSDKIDVVIDSLEITINGVTYTATKKPI

SEQ ID NO: 1583 - protein, 470 aa, Streptococcus suis
MGVNIETAIRWMSDRKGRVTYSMDYRNGPNSFDCSSSVYYALMSAGAISAGWTVNTEYEHDWLIKNGYKLIAENQDWDAKRGDIFIWGKRGQSAGAGGHTGIFIDPDNIIHCNYANNSITINNYNQTAAASGWMYCYVYRLANQSTPSTSGKTLDTLVKETLAGKYGNGDQRKAALGNQYEAVMAVINGKATVPKKTIDQLAQEVIQGKHGNGEDRKKSLGPDYDAVQKRVSELLIKQPSEPSKSPEVKQATESKTSQSEPTKQTTESKEEGDLSFNGAILKKAVLDKILANCKKYDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIEQENGSLAKYDTATVTDVGSTDKIEVNIEGIEISINGVTYTLSKKPV

SEQ ID NO: 1584 - protein, 332 aa, Bifidobacterium longum
MGRFKNKSKPLQALIAALFAVLLACTPAIAMADMVGIDVSGWQASNVTCTAQYDFAVVKVSQGVGFENSSWRTQARCVTDRGKSLGLYHYAGGNNAASEADYFVGRARDYIGRAVLVLDWESYQNAQWGNGDWVRRFAQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPQQTTQANTTRVTVRSGDTMSGIASRTGLWPLSR

SEQ ID NO: 1585 - protein, 411 aa, unidentified
  REGION 1..411: note = Bifidobacterium longum DJO10A
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTEKPPTQTIDLQALATATIRGDYGNGQQRRDALGANYDRVMAIVNQRLAGVATVAPQQTTQANTTRVTVRSGDTMSGIATRTGLWPLSRWSVPSGNLNLIYPGQVVTYNGGGSVATGSNAPPATRTVTVRSGDTLSGIAARLGISYTQLTGYRSGNPNVIYPGEVLRY

SEQ ID NO: 1586 - protein, 412 aa, Bifidobacterium breve
MDIKNKSKPSLVMRILAVVVAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1587 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQSDKIEVAIEGIEVTINGTRYKLTKEPI

SEQ ID NO: 1588 - protein, 250 aa, unidentified
  REGION 1..250: note = Bacteriophage sp.
MDKETFIQKVAEKVRKYAPLYGIEVHSPIIAQAIIESGWGSSVLASRYNNYFGLKCGSMWTGGSVNMHTQEEYQPGTMTNIRDNFRTFEDFDAGIRGYFEFINYSRYSNLKGVTNPREYCEKIKSDGYATSSSYVNNLMRIIQENNLTRFDNSDEPQTDVDIENLAHRVIRGEFGGGEERKVLLGGNYEKVQQRVNELMGNSSPKYDVEDLANRVIRGEFGNGHERKSALEKMEKGLYAKVQAVVNDMLS

SEQ ID NO: 1589 - protein, 250 aa, unidentified
  REGION 1..250: note = Podoviridae sp. ctt6T3
MDKELFIQKVAEKVRKYAPLYGIGVHSPIIAQAIIESGWGSSVLASKYNNYFGLKCGSSWKGGSVNMATREEYKPGVVTNIRDNFRTYEDFDAGIRGYFEFIGYSRYSNLKGVTNPREYCEKLKSDGYATSSSYVDTLMRVIQENNLTRFDNSDKPQSDVDIENLAQRVIKGEFGSGEERKALLGGNYEKVQQRVNEILGSSKPKYNIDDLARRAIRGEFGNGLTRKAKLEKMERGLYDKVQKRINEMMK

SEQ ID NO: 1590 - protein, 400 aa, unidentified
  REGION 1..400: note = Siphoviridae sp. ctZgu8
MRILAVVVAVLLACTPAIAMADMVGIDVSGWQASNVTCTAQYDFAVVKVSQGVGFENGSWRTQARCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1591 - protein, 412 aa, unidentified
  REGION 1..412: note = Siphoviridae sp. ctmJp3
MRKHKPPWLKRIRLAVTGVVMAITMAVAPAAMADLNGYDVSGYQAPDITQVAPADFAIVKVNQGWYINSSWGQQASGAVNTGKELGLYDYASGMDATTEADNFVNHITGYVGKAMLVLDWEPYQNAAWGNSNWVRTWVYRVHARTGVWPVVYCSKGFVDQIPADVRAKCMLWAAQYANNYATGYQDSPWLAGSQGEGMLQYTSTGYLNGHGPLDLDKFFGDRTAWRKIACGERAGCSTTGGSTGTPNVHVEKRTTNTTDLNAMATAVIRGDYGNGADRQSRLGDNYQAVMNIVNSRLSGSTYSGPTTVTRTTTRTYVVRSGDTVSAIAERTGLKPASAWRVPSGNINRIYVGQTITYYGSSTVSTPSTTYSSTHVVSAGESLWKIYGSGWYAAAQRNGLRPPYTIYPGQRLR

SEQ ID NO: 1592 - protein, 418 aa, unidentified
  REGION 1..418: note = Caudoviricetes sp.
MKRFCKRLKPLVLSAVAALCAVGMTAGVAMADLNGIDVSGWQPASITRAAPADFAIIKATEGTNFLSGSWVAQATGAVETGKALGLYHYADGGDAISEADHFVNTIGSYAGRAVLVLDWEGYGNASWGNGSWVRTFVNRVHDRTSVWPMVYVQASAVWQIPSDVRQHCALWKAQYASNAATGYQTSPWNAGSAGESMLQYTSNGRLAGYNGPLDLDRFFGDRTAWGKIACGERRGCVPGSYANTGAPTTNAHATAPAPTQTPNATIGDMATRAIRGEYGNGSARKARLGSYYDAVMAEVNRRLTGAAIPSRPTTPTAVSYCVVVRSGDTLGAIASRSARLPASAWTAPSGNINVIYPGQRVCYRGAVSVARTSSYTTYGHVVRSGESLWSIYGSGWASAAARNGLRYPYTIYPGQALR

SEQ ID NO: 1593 - protein, 258 aa, unidentified
  REGION 1..258: note = Caudoviricetes sp.
MNKTEFIPTIAPLVVAENNKRGNPLFSSVVIAQAICESGWGQSKLMMKANAIFGIKAFSGWKGKVYNANTQECYDGKTYTNITACFRAYNSLAESISDYFDLITKSERYRKACVSNSPLECITAIKNGGYATSPTYINTIMSIINSNNLTKYDNVEDVENSVDNSKSIEELAKEVIAGRYGNGEERKEKLGSLYNEVQKKVNEILKGNIPREKIYIVKKGDCLCNIAKKFNTTVEKIAKDNNITNVDLIYVNQKLIIR

SEQ ID NO: 1594 - protein, 284 aa, unidentified
  REGION 1..284: note = Bacteriophage sp.
MSRMQKVIDVSYHNGTIDWDRVKAAGYHAIIRCGFGSDFRDQDDAQFKRNADECVRLGIPFGAYLYSYAKGAAQAMSEADHAIRLCDPYRDHMAYPLFFDTEEPGTEDVSKTHATIFCSRVRAAGFVPGIYASQAWWLENLPDVDGYVKWVARWSESEPIVHGWQLWQYSERGNVPGIKGNVDLNYSRYEIGNHGDVSTVDDLAREVIAGKYGNGEERKRKLGARASVVQLIVNRGLTGKWTGIDRVAREVIAGKWGNGAVRRENLGSAYDVVQKRVNELMKHK

SEQ ID NO: 1595 - protein, 303 aa, unidentified
  REGION 1..303: note = Caudoviricetes sp.
MNGFDISSHQTGIDLSKIDCDFIITKATEGYYYTNPDFVRSFEQGIATGKRMGIYHYANGTDPIREAKFFLKKIEPYLGKAILCLDWERSNNRSYGYNDANWCMRFMDYVYDTVGIKMFLYISAGLRHKFQKVLDKYYFWAAQYADFSPVYKFQEHPWNEGAYECEIRQYTSCFWMPGIWRSRLDTNKAYITPEQWDAMAALPAEVPEDPAESKYTTDELAQQVLNGKWGNGGERRRLLEEAGYNYEEVQARVNAILADENITRLAREAIAGKYGNGNERREKLGEMYQPVQKRVNQLLGYRC

SEQ ID NO: 1596 - protein, 412 aa, unidentified
  REGION 1..412: note = Caudoviricetes sp.
MRKHKPPWLKRFRLAVTGVVMAIAMVVAPAAMADLNGYDVSGYQAPDITQVAPADFAIVKVNQGWYINSSWGQQASGAVNTGKELGLYDYASGMDATTEADNFVNHINGYVGKAMLVLDWEPYQNAAWGNSNWVRTWVYRVHARTGVWPVVYCSKGFVGQIPADVRAKCMLWAAQYANNYATGYQDSPWLAGSQGEGMLQYTSTGYLNGRGPLDLDKFFGDRTAWRKIACGERAGCSTTGGSTGTPNVHVEKRTTNTTDLNAMATAVIRGDYGNGADRQARLGDNYQAVMNIVNSRLSGSTYSGPTTVTRTTTRTYVVRSGDTVSAIAERTGLKPASAWRVPSGNINRIYVGQTITYYGSSTVSTPSTTYSSTHVVSAGESLWKIYGSGWYAAAQRNGLRPPYTIYPGQRLR

SEQ ID NO: 1597 - protein, 400 aa, unidentified
  REGION 1..400: note = Caudoviricetes sp.
MRILAVVVAVLLACTPAIAMADMVGIDVSGWQASNVTCTASYDFAVVKVSQGVGFENGSWRAQAKCVTDRGKSLGLYHYAGGNNAEAEADYFVGRARDYIGRAVLVLDWESYQNAQWGNSDWVRRFVQRVHTFTGVWPMVYVQASALGQIPGDVRANCGLWVAQYASNAPTGYQSRPWNYSIYGEAMRQYTSNGWVNGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1598 - protein, 367 aa, unidentified
  REGION 1..367: note = Caudoviricetes sp.
MPTHHVGRKTNLGKFKNKSKPITAIIAAFVAMLLAATPAIAMADMVGIDVSGWQAANVTGPASYDFAVVKVSQGVGFENSSWRAQAKCVTDRGKSLGLYHYAGGNNAEAEADYFVGRARDYIGRAVLVLDWESYQNAQWGNSDWVRRFVQRIHTLTGVWPMVYVQASALGQIPGDVRANCGLWVAQYASNAPTGYQSRPWNYAVYGEAMRQYTSNGWISGYNGPLDLNYFRGEASQWQGVPQPPPSSRKPPTQTIDLQALATATIRGDYGNGQQRRDALGANYDKVMAIVNQRLAGVATVAPQQTTQANTTRVTVRSGDTMSGIASRTGLWPLSRWSVPSGNLNLIYPGQVVTYNGGGSGATRRATP

SEQ ID NO: 1599 - protein, 302 aa, unidentified
  REGION 1..302: note = Caudoviricetes sp.
MNGFDISSHQTGIDLSKIDCDFIITKATEGYYYTNPDFVRSFEQGIATGKRMGIYHYANGTDPIKEAKFFLKKIEPYLGKAILCLDWERSNNRSYGYNDADWCMRFMDYVYDTVGIKMFLYISAGLRHKFRKVLDKYYFWAAQYANFEPVYKFQEHPWNEGAYDCEIRQYTSCFWMPGIWRSRLDTNKAYITPEQWDAMAALPVDAPEDPEEPEYTTDELAQQVLNGKWGNGDERRRLLEEAGYKYEEVQARVNAILADENITRLAREVIAGKYGNGDERREKLGEMYQPVQKRVNQLLGYR

SEQ ID NO: 1600 - protein, 369 aa, unidentified
  REGION 1..369: note = Caudoviricetes sp.
MPTQHTGRKTNLGKFKNRSKPLQALIAALFAVLLACTPAIAMADMVGIDVSGWQASNVTCTASYDFAVVKVSQGVGFEHSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVA

SEQ ID NO: 1601 - protein, 250 aa, unidentified
  REGION 1..250: note = Caudoviricetes sp.
MDKEAFIQKVAEKVRKYAPLYGIGVHSPIIAQAIVESGWGSSVLASRYNNYFGLKCGSSWKGGSVNMATKEEYKPGVMTNIRDNFRTYEDFDAGIRGYFEFISYSRYANLKGVTNPREYCEKLKSDGYATSSSYVDTLMRVIQENNLTRFDNSDRPQSDVDIENLAQRVIKGEFGSGEERKVLLGGNYEKVQQRVNEILGSNKPKYDIDDLARRAIRGEFGNGFARKAKLEKMERGLYAKVQKRINEMMK

SEQ ID NO: 1602 - protein, 421 aa, unidentified
  REGION 1..421: note = Caudoviricetes sp.
MSIMKLMKKHERLLLPIALVCLAGLITPTASADMNGIDISGYQATDIPSAVPADFVIVKATQGLRWSNPHYTAQIANADRTGKATGVYHFANGGNAISEADFFINAVYDRLGRSTLNLDWEQCLAYGRYGCTTVNPNWGNQNWIRQWVNRVHDRTRVWPAVYVQRSAVWQVPSDVRAHCMLWVAQYANSLPTGYQRSPWNGGASGEGMTQYASTGYLNGRGPLDLNLFYGDRSAWQKIACGERDGCAVGTVTNAPPTHTETTTPTTDLNAMATAVIRGDYGNGADRQARLGGNYAAVMAIVNARLGGESYSCPATVTATTSRTYVVHTGDTVWAIAERTGLKPASAWRVPSGNINRIYTGQVIAYSGPIATTAASGYYGSSTHVVRAGESLWSIYGTGWASAAVRNGIRSPYLIYPGQRLI

SEQ ID NO: 1603 - protein, 421 aa, unidentified
  REGION 1..421: note = Bacteriophage sp.
MPTHHVGRKTNLGKFKNKSKPLQALIAAFVAMLLAATPAIAMADMVGIDVSGWQASNVTCTASYDFAVVKVSQGVGFENGSWRTQAKCVTDRGKSLGLYHYAGGNNAESEADYFVGRARDYIGKAVLVLDWESYQNAQWGNGDWVRRFAQRVHTLTGVWPMVYVQASALNQIPGDVRANCGLWVAQYASNAPTGYQSRPWNYSIYGEAMRQYTSNGWVNGYNGPLDLNYFRGDAGQWQAYANPAGAAKPATPPQTATPPTQTIDLQALATATIRGDYGNGQQRRDALGANYDRVMAIVNQRLNAGAATQTPQATAPTATRVTVRSGDTMSGIASRTGLWPLSRWSVPSGNLNLIYPGQVVTYNGGGSVATGSNAPPSRTVTVRAGDTLSGIAARLGISYTQLTGYRSGNPNVIYPGEVLRY

SEQ ID NO: 1604 - protein, 275 aa, unidentified
  REGION 1..275: note = Caudoviricetes sp.
MQKVIDVSYHNGVVEWEKVKTAGYHAIIRCGYGSDFENQDDEQFKRNADECTRLGIPWGAYLYSYAKGATQAKSEADHAIRLCEPYKDVMAYPLFFDTEEPGTESISASNATIFCSNVKAAGFAVGIYASQAWWQENLGNVKGYVKWVARWSELKPIISGWQIWQYSSDGNVPGIKGRVDMNYSRYPVTASAVDQMAENTISGIYGNGEARKKVLGNSYNVVQLIVNKKLTGKWTGLDTVAREVIAGKHGNGEARKRNLGSAYDVVQKRVNELLK

SEQ ID NO: 1605 - protein, 237 aa, unidentified
  REGION 1..237: note = Caudoviricetes sp.
MYSCGKNFYNKYKNTAIDYDGVYGVQCVDLFKLQCKELGKKLGAIGGSGYAREIYHRFNALGLSKFFSRHAAGTKSMVYGDWVVWERESADCPDSHVGMFVGWNGDRAKIFGYNQAGKAAASIVSLRTDGMLGFLHPLMMNNGAKEVTDKLVKDIIYGRWGNGQERIEKLEAAGYDADEVQAAVNASLAVKPRPVNAEIVNAVIRGDYGNGAARKANLEKAGYDYDEVQRAVNEKLS

SEQ ID NO: 1606 - protein, 300 aa, unidentified
  REGION 1..300: note = Caudoviricetes sp.
MFKGIDVSVYQGDIDWSRVKPYIDFAILRIGLGDDIPSQDDAKFERNYAECVRLSIPFAVYFFSYAVNKAKVQSEIAHIKRLLEGKTINAPVYIDVENTRGLDWRTISNADMLSIMQEFNTQLNALSYKMGIYSSRSAFWNEKMSDPWYDNVSKWVAEYGDKVNDFNRTYDIWQHTSKGAIDGINGNVDMNVMYNNVFSFEQAPSVKSNEQLADEVINGKWGNGADRKNRLTAAGYNYEAVQAIVNERLGKSNLKSLDEIAREVVRGKWGNGSERVKRLTAAGYDAKAVQSRVNDLMKKR

SEQ ID NO: 1607 - protein, 412 aa, unidentified
  REGION 1..412: note = Caudoviricetes sp.
MRKYKPPWLKRIRLAVTGVVMAITMAVAPAAMADLNGYDVSGYQAPDITQVAPADFAIVKVNQGWYINSSWGQQASGAVNTGKELGLYDYASGMDATTEADNFVNHITGYVGKAMLVLDWEPYQNAAWGNSNWVRTWVYRVHARTGVWPVVYCSKGFVGQIPADVRAKCMLWAAQYANNYATGYQDSPWLAGSQGEGMLQYTSTGYLNGHGPLDLDKFFGDRTAWRKIACGERAGCSTTGGSTGTPNVHVEKRTTNTTDLNAMATAVIRGDYGNGADRQSRLGDNYQAVMNIVNSRLSGSTYSGPTTVTRTTTRTYVVRSGDTVSAIAERTGLKPASAWRVPSGNINRIYVGQTITYYGSSTVSTPSTTYSSTHVVSAGESLWKIYGSGWYAAAQRNGLRPPYTIYPGQRLR

SEQ ID NO: 1608 - protein, 412 aa, unidentified
  REGION 1..412: note = Bifidobacteriaceae bacterium MCC01957
MDIKNKSKPSLVMRILAVVVAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRIHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1609 - protein, 373 aa, unidentified
  REGION 1..373: note = Bifidobacteriaceae bacterium MCC01964
MSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1610 - protein, 412 aa, unidentified; identical to SEQ ID NO: 1580
  REGION 1..412: note = Bifidobacteriaceae bacterium MCC01966

SEQ ID NO: 1611 - protein, 316 aa, Streptococcus suis
DQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1612 - protein, 465 aa, Streptococcus suis
MTINLETSIRWMNDRVGKVSYSMDYRNGPNSYDCSSAVYYALMAGGAISAGWAVNTEYMHDWLIRNGYVLVAENKPFNAKRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYANVDDFLTDWFYLLRVGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1613 - protein, 465 aa, Streptococcus suis
MTINLETSIRWMNDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAVYDYATSGFDSYIVGASSRLKAIESENGTLSKYDTATVTDVGSKDHIDITIDGIEVTINGTRYRLTKEPI

SEQ ID NO: 1614 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQSDKIEVAIEGIEVTINGTRYKLTKEPI

SEQ ID NO: 1615 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATVYDNYLIGMSSRLKAIESENGSLAKYDQQTVTDVGQSDKIEVAIEGIEVTINGTRYKLTKEPI

SEQ ID NO: 1616 - protein, 464 aa, Streptococcus suis
MTINLETSIRWMSDRVGKVSYSMDYRNGPNSYDCSSAVYYALMAGGAISAGWAVDTEYMHDWLIRNEYVLVAENKPFNAQRHDVFIWGKRGYSSGEGGHTGIFVDNVNIIHCNFKRNGITIDDYNKVSRGMYYYLYRPNQPSPSNKSLDQLVKETLAGVHGNGDARKASLGDQYEPVMAVINGKATASEKTVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGSLDKFDKQTVMDVGQSDNIEINVEGIEVIINGETYRLEKKPV

SEQ ID NO: 1617 - protein, 473 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVIINGETYKLEKKPV

SEQ ID NO: 1618 - protein, 465 aa, Streptococcus suis
MTINLETSIRWMNDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 1619 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLSGKYGNGDTRKAALGDQYEAVMAVINGKATEPKKTIDQLAQEVIQGKHGNGEDRKKSLGPDYDAVQKRVSELLKKQPSDPSKTQEVKQVTESKTSQTEPTGQATVSKEDGDLSFNGAILKKAVLDKILANCKKYDILTSYALTILHYEGLWGTSAVGKADNNWGGMTWTGQGNRPSGVTVTQGSARPSNEGGHYMHYAIVDDFLTDWFYLLRAGGSYKVSGAKTFSEAVKGMFKVGGAVYDYAASGFDSYIVGASSRLKAIESENGTLSKYDTAIVTDINQSDDIEINVEGIEVIINGETYKLEKKPV

SEQ ID NO: 1620 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSTDKIEVNIEGIEISINGVTYTLSKKPV

SEQ ID NO: 1621 - protein, 465 aa, Streptococcus suis
MTINLETSIRWMNERVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAAYDYAASGFDSYIVGASSRLKAIESENGTLSKYDTATVTDVGSKDHIDITIDGIEVTINGTRYRLTKEPI

SEQ ID NO: 1622 - protein, 354 aa, Streptococcus suis
ARNGITVDNYNQTAAASGWMYCYVYRLANQTSTSGKSLETLVQETLSGKYGNGDTRKAALGDQYEAVMAVINGKATEPKKTIDQLAQEVIQGKHGNGEDRKKSLGPDYDAVQKRVSELLKKQPSDPSKTQEVKQVTESKTSQTEPTGQATVSKEDGDLSFNGAILKKAVLDKILANCKKYDILPSYALTILHYEGLWGTSAVGKADNNWGGMTWTGQGNRPSGVTVTQGSARPSNEGGHYMHYAIVDDFLTDWFYLLRAGGSYKVSGAKTFSEAVKGMFKVGGAVYDYAASGFDSYIVGASSRLKAIESENGTLSKYDTAIVTDINQSDDIEINVEGIEVIINGETYKLEKKPV

SEQ ID NO: 1623 - protein, 317 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDTRKAALGNQYEAVMAVINGKATASQKSIDELAQEVIAGKHGNGEARKKSLGSQYEAVQKRVSELLKKQPSEPSKCPEVKQTTEAKTSQTEPTGKATESKEEGDLSFNGAILKKAVLDKILDNCKKHDILPSYALTILHYEGLWGTSAVG

SEQ ID NO: 1624 - protein, 483 aa, Streptococcus suis
MAANMEQAIAWMEARRGKVTYSMDYRNGPNSYDCSSSVYFALMSAGAISAGWAVNTEYMHDWLIKNGFKLISENGVFAAQRGDIFIWGRRGQSSGAGGHTGIFVDSNNIIHCNYARNGITVDGYLATARAAGNMYYYIYRPSGQAQVSNSTAGKSIDQLVQETLAGKYGNGDQRKAALGNQYEAVMAVINGKATAPKKTIDQLAKEVIAGKHGNGEDRKKSLGPDYDAVQKRVTEILKGSTSGNTPKTPSDAPKSEVVNSSTETKTEETEATGKVTEPKIVKEAGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAVKGMFKTGGAVYDYAATGYDNYLVGMSSRLKAIEAENGSLTKYDTATVTDVGSTDKIEVNIEGIEISINGVTYTLSKKPV

SEQ ID NO: 1625 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 1626 - protein, 472 aa, Streptococcus suis
MSINIETAIQWMSDRKGRVTYSMDYRNGPNSYDCSSAVYYALMSAGAVSAGWAVNTEYEHDWLIKNGFKLIAENSVFGAQRGDVFIWGKRGQSSGAGGHTGIFVDSNNIIHCNYARNGITVDGYLDIARASGNKYYYIYRPHGQSTASASTAGKSVDQLVQETLAGKYGNGDARKTILGNQYEAVMAVINGKTTTNQKTVDQLAQEVIQGKHGNGEDRKKSLGSQYDAVQKRVTELLKKQSSEPSKSSEVKQPTQTKTSQTEPTEKATVSKEEGDLSFNGAILKKAVLDKILANCKKHDILPSYAITVLHFEGLWGASAVGKADNNWGGMTWTGQGNRPSGVTVTQGTARPSNEGGHYMHYATVDDFLTDWFYLLRAGGSYKVSGAKTFSDAVKGMFKVGGAVYDYATSGFDSYIVGASSRLKAIESENGSLAKYDTATVTAVGSTDKIEVNIEGIEISINGVKYTISKKPV

SEQ ID NO: 1627 - protein, 468 aa, Streptococcus suis
MGVNIETALRWMSDRKGRVTYSMDYRNGPNSFDCSSSVYYALMSAGAISAGWAVNTEYEHDWLIKNGYTLIAENADWDAKRGDIFIWGRRGQSAGSGGHTGIFIDSDNIIHCNYARNGITVDNYNQTAAANGWMYCYVYRLANQTSTSGKSLETLVQETLAGKYGNGDTRKAALGNQYEAVMAVINGKATASQKSIDELAQEVIAGKHGNGEARKKSLGSQYEAVQKRVSELLKKQPSEPSKSPEVKQTTEAKTSQTEPTGQATESKEEGDLSFNGVILKKAVLDKILTNCKKHDILPSYALTILHYEGLWGTSAVGKADNNWGGMTWTGQGNRPSGVTVTQGSARPSNEGGHYMHYASVDDFLTDWFYLLRASGSYKVSGAKTFSEAIKGMFKVGGAVYDYAASGFDSYIVGASSRLKAIESENGTLSKYDTATVTDVGSKDHIDITVDGIEVIINGETYKLEKKPV

SEQ ID NO: 1628 - protein, 451 aa, Streptococcus suis
YRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPNQPSPSNKSLDQLVKETLAGVHGNGDVRKASLGNQYEAVMAVINGKATTNQKTIDQLAQEVIQGKHGNGEDRKKSLGHDYDAVQKRVTEILKGSTSGNTPKTPSDAPKSEVVNSSTEPKTEETGVTGKATDTKITKEDGDLSFNGAVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1629 - protein, 475 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPNQPSPSNKSLDQLVKETLAGVHGNGDVRKASLGNQYEAVMAVINGKATTNQKTIDQLAQEVIQGKHGNGEDRKKSLGHDYDAVQKRVTEILKGSTSGNTPKTPSDAPKSEVVNSSTEPKTEETGVTGKATDTKITKEDGDLSFNGAVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVGSSDKIEVNVEGIEVIINGETYKLEKKPV

SEQ ID NO: 1630 - protein, 473 aa, Streptococcus suis
MTINLETSIRWMSDRVGKVSYSMDYRNGPNSYDCSSAVYYALMAGCAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATESKEDGDLSFNGAVLKKAVLDKILANCKKHDILPSYAITVLHFEGLWGTSAVGKADNNWGGMTWAGQGNRPSGVTVTQGSARPSNEGGHYMHYASVDDFLTDWFYLLRSGGSYKVSGAKTFSEAVKGMFKISGAVYDYAATGYDNYLIGMSSRLKAIESENGSLAKYDQQTVTDLAKTDKIEVAIEGIEVTINGTRYKLTKEPI

SEQ ID NO: 1631 - protein, 473 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWTGKGERPSGVTVTQGTARPANEGGHYMHYASVDDFLTDWFYLLRAGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1632 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1633 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATESKEDGDLSFNGAVLKKAVLDKILANCKKHDILPSYAITVLHFEGLWGTSAVGKADNNWGGMTWAGQGNRPSGVTVTQGSARPSNEGGHYMHYASVDDFLTDWFYLLRSGGSYKVSGAKTFSEAVKGMFKISGAVYDYAATGYDNYLIGMSSRLKAIESENGSLAKYDQQTVTDLAKTDKIEVAIEGIEVTINGTRYKLTKEPI

SEQ ID NO: 1634 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITMNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1635 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGSSSRLKAIEAENGSLDKFDKTTDIGDGSKDKIDITIEGIEVTINGITYELTKKPV

SEQ ID NO: 1636 - protein, 468 aa, Streptococcus agalactiae
MEINTETAIAWMSARQGKVSYSMDYRDGSNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1637 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSEASTQGKSLDILVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1638 - protein, 468 aa, Streptococcus agalactiae
MEINTETAIAWMSARQGKVSYSMDYRDGPNSYDCSSSVYYALRSAGASSAAWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1639 - protein, 449 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITI

SEQ ID NO: 1640 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKISQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1641 - protein, 481 aa, Streptococcus pyogenes
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMAVINGKSTTAQKSVDQLAQEVIAGKHGNGEGRKKALGSQYDAVQKRVTEMLKGSTSGNTPKTPSDAPKSEVVNSSAETKTEETEATGKVTEPKIAKEVGDLSFNGAILKKSVLDVILAKCKEHNILPSYAITVLHFEGLWGTSAVGKGDNNWGGMTWNGTENRPSGITVTQGTARPAVEGGHYMHYASVDDFLTDWFYLLRAGGSYKVSGANTLSEAIKGMFIVGGAKYDYASIGYENYLVGASSRLKAIETENGSLSKFDTATLEDVGSKDKIDITIAGIEVTINGITYELTKKPV

SEQ ID NO: 1642 - protein, 481 aa, Streptococcus pyogenes
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGASGHVVMFVDSDNIIHCNYANNGITINNYNQTATSAGWMYSYVYRLATPATTSTAGKSLDTLVKETLAGNYGNGEMRKAALGNQYDAVMAVINGKSTTAQKSVDQLAQEVIAGKHGNGEDRKKALGSQYDAVQKRVTEMLKTSTSGNTSKTPSEPSNSVVVNSSTEPKTEETGATGKATDTKITKEDGDLSFNGAILKKSALDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1643 - protein, 484 aa, Streptococcus pyogenes
MGINIEAAIAWMLARAGKVTYSMDYRNGPNSYDCSSSVYFALMSAGAISAGWAVNTEYEHDWLIKNGYTLVAEDQDWDSKRGDIFIWGQRGQSSGAGGHTGIFIDPDNIIHCNYAHNGITVNNYNQTAAASGWMYCYVYRLTNQASTPSTSPLGKDLDTLVRETLAGKYGNGDTRKAALGNQYEAVMAVINGKATAPKKTIDQLAQEVIQGKHGNGEERKKALSSDYDAVQKLVTEILKGSTSGNASKTPSDAPKSEVVNSSTEPKTGETRATGKATDTKITKEDGDLSFNGAILKKSVLDVILAKCKEHNILPSYAITVLHFEGLWGTSAVGKADNNWGGMTWTGKGERPSGVTVTQGSARPASEGENYMHYASVDDFLTDWFYLLRADGSYKVSGAKTFSEAVKGMFKVGGAVYDYAATGYDNYLVGMSSRLKAIEAENGSLAKYDTATVDNVGSTDKIEVNIEGIEITINGVTYTISKKPV

SEQ ID NO: 1644 - protein, 411 aa, Bifidobacterium adolescentis
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNGDWVRRFVQRVHTLTGVWPMVYVQASAINQIPSDVRANCGLWVAQYASNAPTGYQSRPWNYAIYGEAMRQYTSNGWVNGYNGPLDLNYFRGDASQWQAYANPAGAAKPVTPPQTEKPPTQTVDLQALATATIRGDYGNGQQRRDALGANYDRVMALVNQRLAGTATVAPQQTTQSNTTRVAVRSGDTMSGIASRTGLWPLSRWSVPSGNLNLIYPGQVVTYNGGGSVATGGNAPPASRTVTVRSGDTLTGIAARLGISYTQLTGYRSGNPNVIYPGEVLHY

SEQ ID NO: 1645 - protein, 410 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVAVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1646 - protein, 332 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVAVRSGDTMSGIASRTGLWPLSRW

SEQ ID NO: 1647 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNGDWVRRFVQRVHTLTGVWPMVYVQASAINQIPSDVRANCGLWVAQYASNAPTDYQSRPWNYAIYGEAMRQYTSNGWVNGYNGPLDLNYFRGDASQWQAYANPAGAAKPVTPPQTEKPPTQTVDLQALATATIRGDYGNGQQRRDALGANYDRVMAIVNQRLAGTATVAPQQTTQSNTTRVAVRSGDTMSGIASRTGLWPLSRWSVPSGNLNLIYPGQVVTYNGGGSVATGGNAPPASRTVTVRSGDTLTGIAARLGISYTQLTGYRSGNPNVIYPGEVLHY

SEQ ID NO: 1648 - protein, 411 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIASRTGLWPLSRWSVPSGNLNLIYPGQVVTYNGGDSVATGSNAPPATRTVTVRAGDTLSGIAARLGISYTQLTGYRSGNPNVIYPGEVLHY

SEQ ID NO: 1649 - protein, 410 aa, Bifidobacterium breve
MGKFKNKSKPITAIIAAFVAMLLACTPAIAMADMVGIDVSGWQASNVTCTASYDFAVVKVSQGVGFENSSWRTQAKCVTDRGKSLGLYHYAGGNNAASEADYFVGRARDFVGRAVLVLDWESYQNAQWGNGDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWRAYANPAGAAKPATPPQTEKPPTQTVDLQALATATIRGDYGNGQQRRDALGANYDKVMAIVNQRLAGTATVAPQQTTQANTTRVTVRSGDTMSGIASRTGLWPLSRWSVPSGNLNLIYPGQVVTYNGGGSVATGSNAPPSRTVTVRAGDTLSGIAARLGISYTQLTGYRSGNPNVIYPGEVLRY

SEQ ID NO: 1650 - protein, 470 aa, Streptococcus suis; identical to SEQ ID NO: 1583

SEQ ID NO: 1651 - protein, 240 aa, unidentified
  REGION 1..240: note = Clostridia bacterium
MFKLALNAGHGYNTAGKRCLKSIDPKETREYVLNKRICDYIQKTLSEYKDIEVLRTDDGSEISVAKRAATANKFNADVYISVHHNAGIKGGKGGGIEAYVYLNVDSKTKDWQKSLYDSLISTTALKGNRAMPIKSANFGELRLTKMPAVLLECGFMDSLVDTPIILTDEFAQKAAQAIADTVIQKSGLKKTPTAKKTTEQIALEVIRGEWGNGAERKQRLAAAGYNYTTIQRRVNKILKG

SEQ ID NO: 1652 - protein, 483 aa, Treponema sp.
MKELRGIDISEWNGGLNYTALAKNIDFAILREGCRTRKDYLFDTHINGCRAARIPIRGVYHFIYAVNDHQAKLEAESCIKNVQAAGLPKSTYIWADLEYDTITKAKAQGVNLGPAEVRQFTETFCATVKAAGYPTGIYTNLDYWIRMYGDEILSRYPVWYAQYSSKRSKDCLIWQCGSRVLPGSNGQALDYDIWYESEDVVAEPVATELTKSTEELAKEVIAGKWGSGEARKVALGSRYDEVQKKVNEMLAPKPSANVEDYVLEPPNIEQLAQDVIAGKYGIGDARKKSLGANYDAVQKRVNELMKAKTEVVTVAYSDKRLTFVAQMQRWIGLKEADGSFKKIINTYNRGLANAVKRWGTRNVQMVYSWAWCACTVSAAAMACGLDDIIPIEISCPYMIEIAKKFGIWQESDSYRPNPGDIIMYDWQDTGYGDNVGVADHVGVVESVEGNRFTVIEGNRNDSVSRRQMVVNTIYIRGYITPIF

SEQ ID NO: 1653 - protein, 164 aa, unidentified
  REGION 1..164: note = Candidatus Colicola equi
MVQVGFAISQYTKSNLTYQASLAININSLIDKKKTYIPTTPIANKQVELFDTVSIHTPAPEKPIIQDSISTIKDSVPSVIIDTIPQEVPIPSIEEYTEEVEEEVEVVEEVQLEENEQPIDAYQEAWTVIKGTYGNGEERKQRLGKNYTTIQNIVNELYKKELVK

SEQ ID NO: 1654 - protein, 296 aa, unidentified
  REGION 1..296: note = Alphaproteobacteria bacterium
MTDKEKFLDTAWKYLSCNGDYVCNKKLHLGYITHWCAYAVSAIMKDCGFIGKYIKEVEGGAGSIPRKSDGKYGKWFKKSVNMPPQRGDLFFLRYDDYPEHDKYFCDHVGIVEEVNGNILTTLEGNVDAINGNKWAETSIFKRKYRKLYDENNDVVYAFYRPNWKTEVKTTNTSAKKDVEIYQLNSSKEVDYFVRVTASDGLNIRQGAGVKFNKLGAVPFNEVVKVTRQTSGGAYKWGLVEYDGVKGWIALNFTKKTSIEQLARDVIKGKYGNGAERKEILGTLYDEVQAKVNEILS

SEQ ID NO: 1655 - protein, 190 aa, unidentified
  REGION 1..190: note = Oscillospiraceae bacterium
MADKKFNALEALKEKFTKKTETAATAAAEAVKPVQAAAAQATAKTDNAKLAQEAAAKAAAAKEAAAAKEKVTSGRPIATARPMAAATPKKSVDELAKEVIRGDWGNGQERKDKLAAAGYNYDEVQDRVNAILYGNTTTATPLSATKKSVEEIAKEVIRGNWGNGQERKDKLAAAGYNYDEVQAKVNELLK

SEQ ID NO: 1656 - protein, 189 aa, Parasporobacterium sp.
MADKKFNALEALKEKFTKNAETNATAAKPAVEPVTAKPSTDNAKLAQEAAAKAAALREEAAKKAAEKAKVTTGRPVATARPTSTPAKKSVDELAKEVIRGDWGNGQERKDKLAAAGYNYDEVQDRVNAILNGIATATAAPLSATKKSVEEIAKEVIRGNWGNGQERKDKLAAAGYNYDEVQAKVNELLK

SEQ ID NO: 1657 - protein, 189 aa, unidentified
  REGION 1..189: note = Oscillospiraceae bacterium
MADKKFNALEALKEKFTKNAETNATAAKPAVEPVTAKPSTDNAKLAQEAAAKAAALREEAAKKAAEKAKVTTGRPVATARPTSTPAKKSVDELAKEVIRGDWGNGQERKDKLAAAGYNYDEVQDRVNAILNGTATATAAPLSATKKSVEEIAKEVIRGNWGNGQERKDKLAAAGYNYDEVQAKVNELLK

SEQ ID NO: 1658 - protein, 252 aa, unidentified
  REGION 1..252: note = Carnobacteriaceae bacterium zg-ZUI78
MWGNGAERTELLKKAGYNVEDVQAKVNSLLGYNTNENERSIDELAQDVIDGKLGNGEQRKQALGDKYDAVQAKVNELLTKREDVPASEPENKSDGVLNYKGSSLSQEVLDKIIALCKHYDILPSYAITVLHYEGLWGTSNVGITDNNWAGMTMPDGKETVVRDSGVTVTKGSARRQIEGGYYMHYETVDDFLKDWFHLMRNGYMYCVSGVRSFSECVKGMFKVGGAYYDYAATGYENYLVGMTSRLAEIEKV

SEQ ID NO: 1659 - protein, 295 aa, unidentified
  REGION 1..295: note = Carnobacteriaceae bacterium zg-ZUI78
MWGNGAERTELLKKAGYNVEDVQAKVNSLLGYNTNENERSIDELAQDVIDGKLGNGEQRKQALGDKYDAVQAKVNELLTKREDVPASEPENKSDGVLNYKGSSLSQEVLDKIIALCKHYDILPSYAITVLHFEGLWGTSNVGITDNNWAGMTMPDGKETVVRDSGVTVTKGSARRQIEGGYYMHYETVDDFLKDWFHLMRNGYMYCVSGVKSFSECVKGMFKVGGAYYDYAATGYENYLIGMTSRLAEIEKVNGSLSKYDDMIYKKEEVKHDKIEIVFENIEVNINGVPYILKKK

SEQ ID NO: 1660 - protein, 292 aa, unidentified
  REGION 1..292: note = Bacillota bacterium
MSNSSLVNYTAISPNSSNPRNNKIKKITIHHMAGNLSVETCGRVFNGKNRQASSNYGIGSDGRVGMYVEEKNRAWTSSSPSNDNQAITIEVANDGGANTNWHVSDKALAKLIDLCVDICKRNGIASLNYTGDANGNLTRHNMFANTTCPGPYLQSKFPYIASEVNKRLNGSSTSVPSNDISSKSVDELAKEVIAGKYGNGDARKSALGSRYGEVQARVNEILIGNKPTPTPAPQPTESNDDLLTLVKKTIRGDFGNGDARKKALGSRYDEVQKQVNANLNAGLTRWDNIKLF

SEQ ID NO: 1661 - protein, 47 aa, Streptococcus agalactiae
MTNREIMIEELAQEVIRGTFGNGNERKQRLGTLYHEVQNKVNAILWR

SEQ ID NO: 1662 - protein, 413 aa, unidentified
  REGION 1..413: note = Bifidobacteriales bacterium
MRWSHARHARAKPRYARIMVGAMAALAMLSPGVAYADAGFDNASYQGCYNAQAAKASGASFSITKITEGTGYVNPAANCQLAANKAAGLRIGAYGYARPEYGNSPEAEADFFNAQANSRGLVHAGVIPFLDWEPPARYRGDTEWAKRWLDRVASYWGTKPIIYMSASTISAGDWTAVAGADYGLWVAGYPHGYKGERLRDPGAPPYSVAPWPFAAAWQYSSTGHVPGVGNAVDVNWFYGDAATWARYANAPVGTQANPVTPSPTPSQGAPVGDVGSLATAVIRGEYGNDPQRRALLGNRYDEVMAVVNERLRGNARGSNGSGTYVVRPGDSLSAVFGGSWPMVARLNGIRAPYVIHPGQRLATGHGGGGRTVTVRRGDTLSGIAARLGIPQSQLHGYRSGNPNLIYAGETLRY

SEQ ID NO: 1663 - protein, 410 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVAPQQTTQANTTRVTVRSGDTMSGIASRTGLWPLSRWSVPSGNLNLIYPGQVVTYNGGGSVATGSNAPPASRTVTVRAGDTLSDIAARLGISYTQLTGYRSGNPNVIYPGEVLHY

SEQ ID NO: 1664 - protein, 209 aa, unidentified
  REGION 1..209: note = Porphyromonadaceae bacterium
MANDKKKRTFNLDKGEKRTFNLAKEDDEEIDVVVPEPQPEPPESPTEQIKEGNGMDHGKKPIPKGVYAILAVCVLAAIGLLIWWLVPGNQEETVAPDSEGIADTASAPADSAQAPENTLPQDAAPADEASPSASENAPASENAPATPAKEAAPATPASAETPAEAPSGSIDEQAQKAIQGVYGNGRTRRDNLGSTYREVQDRVNELLKK

SEQ ID NO: 1665 - protein, 94 aa, unidentified
  REGION 1..94: note = Muribaculaceae bacterium
AASSGVAVIEETVGTVQEGVSDAAAGAVSNAKAKVSGAVGNAAAAASTDVSAATIDAEARRVIHGDFGNGAQRKAALGSHYAAVQQRVNKLLHV

SEQ ID NO: 1666 - protein, 192 aa, unidentified
  REGION 1..192: note = Oscillospiraceae bacterium
MADKKFNALEALKEKFTKKTETAATTAAEAVKPVQAAAAQATSTAKTDNAKLAQEAAAKAAAAKEAAAAKEKVTSGRPIATARPVSTAPKKTIDELATEVIRGDWGNGQERKDKLAAAGYNYDEVQDKVNAILYGNTATTATPLSTTKKSVEEIAKEVIRGNWGNGQERKDKLAAAGYNYDEVQAKVNELLK

SEQ ID NO: 1667 - protein, 175 aa, unidentified
  REGION 1..175: note = Bifidobacteriaceae bacterium
QTTTPPQAEKPPTQTVDLQALATAAIRGDYGNGQQRRDALGANYDRVMAIVNQRLNGTTTVVPQQTTQANTTRVTVRSGDTMSGIASRTGLWPLSAWSVPSGNLNVIYPGQVVTYNGGGSVATGSNAPPATRTVTVRSGDTLGGIAARLGIGYTQLTGYHSGNPNLIYPGEVLHY

SEQ ID NO: 1668 - protein, 410 aa, Bifidobacterium sp.
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQRRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1669 - protein, 41 aa, Collinsella sp.
MDIDALARTVIRGTYGNGESRKQKLGCLYSTIQKRVGEILI

SEQ ID NO: 1670 - protein, 411 aa, Bifidobacterium breve
MGRFKNKSKPLQALIAALFAVLLACTPAIAMADMVGIDVSGWQASNVTCTAQYDFAVVKVSQGVGFENSSWRTQAKCVTDRGKSLGLYHYAGGNNAASEADYFVGRARDYIGRAVLVLDWESYQNAQWGNGDWVRRFAQRVHTLTGIWPIVYVQASALNQIPSDVRANCGLWVAQYASNAPTGYQSRPWNYAIYGEAMRQYTSNGWVNGYNGPLDLNYFRGGASQWQAYANPAGAAKPATPPQTATPPTQTIDLQALATATIRGDYGNGQQRRDALGANYDKVMAIVNQRLAGVATVAPQQTTQANTTRVTVRSGDTMSGIASRTGLWPLSKWSVPSGNLNLIYPGQVVTYNGGGSVATGSNAPPATRTVTVRAGDTLSDIAARLGISYTQLTGYRSGNPNVIYPGEVLHY

SEQ ID NO: 1671 - protein, 359 aa, Bifidobacterium longum
MRILAVVVAVLLACTPAIAMADMVGIDVSGWQASNVTCTASYDFAVVKVSQGVGFENSSWRTQAKCVTDRGKSLGLYHYGDWVRRFVQRVHTLTGVWPMVYVQASAINQIPSDVRANCGLWVAQYASNAPTGYQSRPWNYAIYGEAMRQYTSNGWVNGYNGPLDLNYFRGDASQWQAYANPAGAAKPVTPPQTEKPPTQTVDLQALATATIRGDYGNGQQRRDALGANYDRVMAIVNQRLGSATVATQQTTQANTTRVAVRSGDTMSGIASRTGLWPLSRWSVPSGNLNLIYPGQVVTYNGGGSVATGGNAPPASRTVTVRSGDTLTGIAARLGISYTQLTGYRSGNPNVIYPGEVLHY

SEQ ID NO: 1672 - protein, 411 aa, Bifidobacterium longum
MGKIKNKSKPLQALIAAFVAMLLAATPAIAMADMVGIDVSGWQASNVTCTAQYDFAVVKVSQGVGFENGSWRTQARCVTDRGKSLGLYHYAGGNNAASEADYFVGRARDYIGRAVLVLDWESYQNAQWGNSDWVRRFVQRVHTLTGIWPIVYVQASALSQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSRWSVPSGNLNLIYPGQVVTYNGGGSVATGSNAPPATRTVTVRAGDTLSGIAARLGIGYTQLTGYRSGNPNVIYPGEVLHY

SEQ ID NO: 1673 - protein, 389 aa, Bifidobacterium breve
MMLLPATAMADTVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1674 - protein, 400 aa, Bifidobacterium breve
MRILAVVVAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRIHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1675 - protein, 400 aa, Bifidobacterium breve
MRILAVVVAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRIHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1676 - protein, 411 aa, Bifidobacterium pseudocatenulatum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNGDWVRRFVQRVHTLTGVWPMVYVQASAINQIPSDVRANCGLWVAQYASNAPTGYQSRPWNYAIYGEAMRQYTSNGWVNGYNGPLDLNYFRGDASQWQAYANPAGAAKPVTPPQTEKPPTQTVDLQALATATIRGDYGNGQQRRDALGANYDRVMAIVNQRLAGTATVAPQQTTQSNTTRVAVRSGDTMSGIASRTGLWPLSRWSVPSGNLNLIYPGQVVTYNGGGSVATGGNAPPASRTVTVRSGATLTGIAARLGISYTQLTGYRSGNPNVIYPGEVLHY

SEQ ID NO: 1677 - protein, 295 aa, unidentified
  REGION 1..295: note = Granulicatella sp. zg-ZJ
MWGNGAERTELLKKAGYNVEDVQAKVNSLLGYNTNENERSIDELAQDVIDGKLGNGEQRKQALGDKYDAVQAKVNELLTKREDVPASEPENKSDGVLNYKGSSLSQEVLDKIIALCKHYDILPSYAITVLHFEGLWGTSNVGIIDNNWAGMTMPDGKETVVRDSGVTVTKGSARRQIEGGYYMHYETVDDFLKDWFHLMRNGYMYCVSGVKSFSECVKGMFKVGGSYYDYAATGYENYLIGMTSRLAEIEKVNGSLSKYDDMIYKKEEVKHDKIEIVFENIEVNINGVPYILKKK

SEQ ID NO: 1678 - protein, 465 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1679 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETEPTGQATESKEDGDLFFNGAILKKSVLDVILAKCKKHDILPSYAITVLHFEGLWGTSAVGKVDNNWGGMTMTSNDLQITRPSGVIVTRGLARPSNEGGHYMHYASVDDFLTDWFYLLRSGGSYKVSGAKTFSEAVKGMFKVGGAVYDYAATGYDNYLVGMSSRLKAIESENGSLAKYDQQTVTDVGQSDKIEVAIEGIEVTINGTRYKLTKEPI

SEQ ID NO: 1680 - protein, 476 aa, Streptococcus suis
MTINLETSIRWMSDRVGKVSYSMDYRNGPNSYDCSSAVYYALMAGGAISAGWAVDTEHMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATASQKTIDELVQEVIAGKHGNGEERKKSLGPDYDAVQKRVTEILQGSTSGNAPKLASDAPKNEVVNSSTEPKTEETGATGKATESKEAGDLSFNGAILKKSVLDVILTKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 1681 - protein, 465 aa, Streptococcus suis
MTINLETSIHWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATTSQKSVDQLAQEVIAGKHGNGEARKKSLGSQYDAVQKRVTELLKKQPSDPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIEFENGSLDKFDKQTVMDVGQSDKIEVAIEGIDVTINGTRYRLTKEPI

SEQ ID NO: 1682 - protein, 468 aa, Streptococcus suis
MTVNIETAIAWMSARAGKVTYSMDYRNGPNSFDCSSSVYYALMSAGAISAGWAVNTEYEHDWLVKNGYKLIAENTDWDAQRGDIFIWGRRGQSSGAGGHTGIFIDPDNIIHCNWSRKGISVDNYNATAAASGWMYCYVYRLKSGASTQEKSLDQLVKETLAGAYGNGEARKAALGNQYEAVMAVINGKTTTNQKTVDQLAQEVIAGKHGNGEARKKSLGSQYDAVQKRVTELLKKQPSEPSESSEVKQPTQTKINQTEPTGQATATKEEGDLSFNGAILKKAVLDKILANCKKHDILPSYALTILHYEGLWGTSAVGKADNNWGGMTWTGQGNRPSGVTVTQGSARPSNEGGHYMHYASIDDFLTDWFYLLRSGGSYKVSGAKTFSEAVKGMFKVGGAVYDYAASGFDSYIVGTSSRLKAIEAENGSLDKFDKATDIGDGSKDKIDITIEGIEVTINGITYELTKKPV

SEQ ID NO: 1683 - protein, 468 aa, Streptococcus suis
MTINLETSIRWMSDRVGKVSYSMDYRNGPNSYDCSSAVYYALMAGGAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLDQLVKETLAGVHGNGDARKASLGNQYEPVMAVINGKATAAKKSIDELVQEVIAGKHGNGEERKKSLGHDYDAVQKRVTELLKKQPSEPSKVQEVKQPTENKTSQTEPTGQATATKEEGDLSFNGAVLKKDVLDKILDNCIKHDILPSYALTVLHFEGLWGISAVGKADNNWGGMTMTSNDLQIPRPSGVIVTRGLARPSNEGGHYMHYASVDDFLTDWFYLLRAGGSYKVSGAKTFSEAVKGMFKVGGAVYDYAASGFDSYIIGASSRLKAIESENGSLAKYDQQTVTDVGQSDKIEVAIEGIEVTINGTRYRLTKEPI

SEQ ID NO: 1684 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGQADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1685 - protein, 342 aa, unidentified
  REGION 1..342: note = Streptococcus phage Javan616
MYCYVYRLVNQPTTSPSGKNIDTLVKETLAGKYGNGEARKAALGNQYEAVMAVINGKATTSQKTVDQLAQEVIAGKHGNGEARKKSLGSQYDAVQKRVTEILKNGTSSNAPKTASNNKEVKQSTQSKTSQSESIGQATAAKENGDLSFNGAILKKVVLDKILVNCKKHDILPSYAITVLHFEGLWGTSAVGKADNNWGGTTWTGKGERPSGVTVTQGTARPANEGGHYMHYSSVDDFLTDWFYLLRKDGSYKVAGAKTFSDSIKGMFKVGGATYDYAASGFDSYIVGVSSRLKAIEAENGSLDKFDKQTVTDVGQSDKIEVTIEGVEIAINGVAYTLTKKTI

SEQ ID NO: 1686 - protein, 410 aa, Bifidobacterium longum
MGRFKNKSKPLQALIAALFAVLLACTPAIAMADMVGIDVSGWQAANVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGIWPMVYVQASALNQIPSDVRANCGLWVAQYASNAPTGYQSRPWNYSIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLGSATVVPQQTTQANTTRVTVRSGDTMSGIASRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1687 - protein, 490 aa, unidentified
  REGION 1..490: note = Streptococcus phage A1
MTSGRKVSDMAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMVVINGKSTTAQKSVDQLAQEVIAGKHGNGEGRKKALGSQYDAVQKRVTEMLKTSTSGNTSKTPSEPSNSVVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1688 - protein, 411 aa, Bifidobacterium adolescentis
MGKIKNKSKPLQALIAAFVAMLLAATPAIAMADMVGIDVSGWQASNVTCTAQYDFAVVKVSQGVGFENGSWRTQARCVTDRGKSLGLYHYAGGNNAASEADYFVGRARDYIGRAVLVLDWESYQNAQWGNSDWVRRFAQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDKVMAIVNQRLAGVATVAPQQTTQANTTRVTVRSGDTMSGIATRTGLWPLSRWSVPSGNINRIWPGQVVTYNGGGSVATGGNAPPATRTVTVCAGDTLSDIAARLGISYTQLTGYRSGNPNVIYPGEVLHY

SEQ ID NO: 1689 - protein, 332 aa, unidentified; identical to SEQ ID NO: 1584
  REGION 1..332: note = Bifidobacterium longum subsp. longum

SEQ ID NO: 1690 - protein, 281 aa, unidentified
  REGION 1..281: note = Bacteriophage sp.
MQKVIDVSYHNGTIDWDRVKAAGYHAIIRCGFGSDFRDQDDAQFKRNADECVRLGIPFGAYLYSYAKGAAQAMSEADHAIRLCDPYRDHMAYPLFFDTEEPGTEDVSKTHATIFCSRVRAAGFVPGIYASQAWWFENLPDVDGYVKWVARWSESEPIVHGWQLWQYSERGNVPGIKGNVDLNYSRYEIGNHGDVSTVDDLAREVIAGKYGNGEERKRKLGARASVVQLIVNRGLTGKWTGIDRVAREVIAGKWGNGAVRRENLGSAYDVVQKRVNELMKQK

SEQ ID NO: 1691 - protein, 423 aa, unidentified
  REGION 1..423: note = Streptococcus dysgalactiae subsp. equisimilis
MHDWLIKNGYVLIAENQDWNSQRGDCCYWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMVVINGKSTTAQKSVDQLAQEVIAGKHGNGEGRKKALGSQYDAVQKRVTEMLKTSTSGNTSKTPSEPSNSVVVNSSTEPKTEETGATGKATDTKITKEDGDLSFNGAILKKSVLDVILAKCKEHNILPSYAITALHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1692 - protein, 390 aa, unidentified
  REGION 1..390: note = Bifidobacterium longum subsp. infantis
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPADAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPSRTVTVRASASATRSSPAIAAATPT

SEQ ID NO: 1693 - protein, 468 aa, unidentified
  REGION 1..468: note = Streptococcus
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1694 - protein, 481 aa, Streptococcus dysgalactiae
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFIDADNIIHCNYARNNITIDNYNQTAASAGWMYSYVYRLATPATTSTAGKSLDTLVKETLAGNYGNGEMRKAALGNQYDAVMVVINGKSTTAQKSVDQLAQEVIAGKHGNGEGRKKALGSQYDAVQKRVTEMLKTSTSGNTSKTPSEPSNSVVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1695 - protein, 410 aa, Bifidobacterium adolescentis
MGKIKNKSKPLQALIAALFAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1696 - protein, 410 aa, Bifidobacterium longum
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPADAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPSRTVTVRAGDTLGGIAARLGIGYTQLTGYRSGNPNVIYPGEVLRY

SEQ ID NO: 1697 - protein, 410 aa, Bifidobacterium longum
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPADAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1698 - protein, 410 aa, unidentified
  REGION 1..410: note = Bifidobacterium
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1699 - protein, 258 aa, unidentified; identical to SEQ ID NO: 40
  REGION 1..258: note = Propionimicrobium lymphophilum

SEQ ID NO: 1700 - protein, 410 aa, Bifidobacterium breve
MGRFKNRSKPLQALIAALFAVLLACTPAIAMADMVGIDVSGWQASNVTCTAQYDFAVVKVSQGVGFENSSWRTQARCVTDRGKSLGLYHYAGGNNAASEADYFVGRARDYIGRAVLVLDWESYQNAQWGNSDWVRRFVQRVHTLTGVWPMVYVQASALGQIPGDVRANCGLWVAQYASNAPTGYQSRPWNYSIYGEAMRQYTSNGWVNGYNGPLDLNYFRGDASQWRAYANPAGAAKPATPPQTERPPTQTVDLQALATATIRGDYGNGQQRRDALGANYDRVMAIVNQRLGSATVAPQQAAQANTTRVTVRSGDTMSGIASRTGLWPLSRWSVPSGNLNLIYPGQVVTYNGGGSVATGSNAPPASRTVTVRSGDTLSGIAARLGISYTQLTGYRSGNPNVIYPGEVLCY

SEQ ID NO: 1701 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVKKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1702 - protein, 410 aa, unidentified
  REGION 1..410: note = Bifidobacterium
MGKFKNKSKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQSSALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPSGNLNLIYPGQVVTYNGGGSTATAGNAPPATRTVTVRSGDTLSGIAARLGISYTQLSGYRSGNPNVIYPGEVLRY

SEQ ID NO: 1703 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLSGKYGNGDTRKAALGDQYEAVMAVINGKATEPKKTIDQLAQEVIQGKHGNGEDRKKSLGPDYDAVQKRVSELLKKQPSDPSKTQEVKQVTESKTSQTEPTGQATVSKEDGDLSFNGAILKKAVLDKILANCKKYDILPSYALTILHYEGLWGTSAVGKADNNWGGMTWTGQGNRPSGVTVTQGSARPSNEGGHYMHYAIVDDFLTDWFYLLRAGGSYKVSGAKTFSEAVKGMFKVGGAVYDYAASGFDSYIVGASSRLKAIESENGTLSKYDTAIVTDINQSDDIEINVEGIEVIINGETYKLEKKPV

SEQ ID NO: 1704 - protein, 454 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDSDNIIHCNYARNGITVDNYNQTAAASGWMYCYVYRLANQTSTTGKSLETLVQETLAGKYGNGDTRKAALGNQYEAVMSVINGKATASQKSIDELAQEVIQGKHGNGEERKKSLGSQYEAVQKHVSELLKKQPSEPPKSPEVKQTTESKEEGDLSFNGAILKKAVLDKILDNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSESVKGMFKVGGAVYDYAASGFDSYIVGASSRLKAIESENGSLDKFDKLTVTDVGSKDHIDITVDGIEVIINGETYKLEKKPV

SEQ ID NO: 1705 - protein, 411 aa, Bifidobacterium breve
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVREGDTLSGIAARLGIGYTQLTGYRSGNPNVIYPGEVLHY

SEQ ID NO: 1706 - protein, 269 aa, Eremococcus coleocola
MSNSPLVQATILSPNHSGRRNQKITKIAIHHAAGVINGRNLAGIFVQRTRQASANYNLGSDGVIVLGVDESNRAWTTSFSWCDNRAVTIEVGNSTRGPQWLVFDYVLNRLIDLVTDICRRNGIYPCTFTAGKDGVLQKDEWYKNTNCPGPYLGSKFPYIANEVNKRLRGNNTVSKPVGGIYRVRKSWSDVKSQKGAFKNLENAKRCADRFRLKVFDANGKIVYPVGKTSDQLAREVISGKWGNGEERKRRLTQAGYDYKEVQKRVNELI

SEQ ID NO: 1707 - protein, 475 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPNQPSPSNKSLDQLVKETLAGVHGNGDVRKASLGNQYEAVMAVINGKATTNQKTIDQLAQEVIQGKHGNGEDRKKSLGHDYDAVQKRVTEILKGSTSGNTPKTPSDAPKSEVVNSSTEPKTEETGVTGKATDTKITKEDGDLSFNGAVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1708 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDEYNKVSRGMYYYLYRPINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQSDKIEVAIEGIEVTINGTRYKLTKEPI

SEQ ID NO: 1709 - protein, 465 aa, Streptococcus suis
MTINLETSIRWMNDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1710 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQSDKIEVAIEGIEVTINGTRYKLTKEPI

SEQ ID NO: 1711 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVDKTDKIEVAIEGIEVTINGTRYKLTKEPI

SEQ ID NO: 1712 - protein, 465 aa, Streptococcus suis
MTINLETSIRWMNDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATTSQKSVDQLAQEVIAGKHGNGEARKKSLGSQYDAVQKRVTELLKKQPSDPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1713 - protein, 414 aa, Bifidobacterium adolescentis
MRKHKPPWLKRFRLAVTGVVMAIAMVVAPAAMADLNGYDVSGYQAPDITQVAPADFAIVKVNQGWYINSSWGQQASGAVNTGKELGLYDYASGMDATTEADNFVNHITGYVGKAMLVLDWEPYQNAAWGNSNWVRTWVYRVHARTGVWPVVYCSKGFVGQIPADVRAKCMLWAAQYANNYATGYQDSPWLAGSQGEGMLQYTSTGYLNGRGPLDLDKFFGDRTAWRKIACGERAGCSTTGGSTGTPTIHVEKRTTNTTDLNAMATAVIRGDYGNGADRQARLGDNYQAVMNIVNSRLSSSACSGPTTVTRTKTRTYVVRSGDTVSAIAERTGLKPASAWRVPSGNINRIYVGQTITYYGSSTVPTPSTTYYGSSTHVVSSGESLWKIYGAGWYAAAQRNGLRPPYTIYPGQRLR

SEQ ID NO: 1714 - protein, 373 aa, Bifidobacterium longum
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPADAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPSRTVTVRA

SEQ ID NO: 1715 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGKRGQSAGAGGHTGIFIDSDNIIHCNYARNGITVDNYNQTAAASGWMYCYVYRLANQTSTSGKSLEILVQETLAGNYGNGDTRKAALGNQYEAVMAVINGKATASQKSIDELAQEVIAGKHGNGEDRKKSLGSQYEAVQKRVSELLKKQPSEPSKSPEVKQATESKTSQTEPTGKATVSKEEGDLSFNGAILKKAVLDKILAKCKEHDILPSYALTILHYEGLWGTSAVGKTDNNWGGMTWTGQRNRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 1716 - protein, 481 aa, Streptococcus suis
MAVNIEAAIAWMSARVGKVTYSMDYRNGPGSYDCSSSVYYALMSAGAISAGWAVNTEYEHDWLVKNGYKLIAENQDWDAKRGDIFIWGKRGQSAGAGGHTGIFIDADNIIHCNYANNSITINNYNQTAAASGWMYCYVYRLANQSTPSTSGKNLDTLVKETLAGKYGNGDQRKAALGNQYEAVMAVINGKATAPKKTIDQLAQEVIQGKHGNGEDRKKSLGPDYDAVQKRVTEILKGSTSGNAPKTPSDAPKSEVVNSSTEPKTGETGAIGKTTDTEITKEDGDLSFNGAILKKAVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAVKGMFKVGGAVYDYAATGYDNYLVGMSSRLKAIEAENGSLTKYDTATVTDVGSTDKIEVNIEGIEISINGVTYTLSKKPV

SEQ ID NO: 1717 - protein, 481 aa, Streptococcus suis
MAVNIEAAIAWMSARVGKVTYSMDYRNGPGSYDCSSSVYYALMSAGAISAGWAVNTEYEHDWLVKNGYKLIAENQDWDAKRGDIFIWGRRGQSSGAGGHTGIFVDPDNIIHCNYANNSITINNYNQTAAASGWMYCYVYRLANQSTPSTSGKTLDTLVKETLAGKYGNGDQRKAALGNQYEAVMAVINGKATVPKKTIDQLAQEVIQGKHGNGEDRKKSLGPDYDAVQKRVTEILKGSTSGNTPKTPSDAPKSEAVNSFTETKTEETEATGKVTEPKIVKEAGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAVKGMFKIGGAVYDYAATGYDNYLVGMSSRLKAIEAENGSLTKYDTATVTDVGSTDKIEVNIEGIEITINGVTYTLSKKPV

SEQ ID NO: 1718 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGKRGQSAGAGGHTGIFIDSDNIIHCNYARNGITVDNYNQTAAASGWMYCYVYRLTNQTSTSGKSLETLVQETLAGKYGNGDTRKAALGNQYEAVMAVINGKATASQKSIDELAQEVIAGKHGNGEARKKSLGSQYEAVQKRVSELLKKQSSEPSKSPEVKQVTETKTSQTEPTGQATASKEEGDLSFNGAILKKAVLDKILANCKKHDILPSYALTILHYEGLWGMSAVGKADNNWGGMTWTGQGNRPSGITVTQGYARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 1719 - protein, 468 aa, Streptococcus suis
MTINLETSIRWMSDRIGKVSYSMDYRNGPNSYDCSSAVYYALMAGGAISAGWAVDTEHMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDQLAQEVIQGKHGNGEARKQSLGADYPAVQRRVTELLKKQSSEPSKGVEVNQPTETKTSQTEPPGQATVTKEEGDLSFNGAILKKSVLDVILAKCKEQNILPSYAITVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKTGDAVYDYAATGYDNYLVGMSSRLKAIESENGSLAKYDQQTVTDVAKTDKIEVAIEGIEVTINGTRYRLTKEPI

SEQ ID NO: 1720 - protein, 481 aa, Streptococcus suis
MSVNIEAAIAWMSARVGKVTYSMDYRNGPGSYDCSSSVYYALMSAGAISAGWAVNTEYEHDWLVKNGYKLIAENQDWDAKRGDVFIWGRRGQSSGAGGHTGIFIDADNIIHCNYANNSITINNYNQTAAASGWMYCYVYRLANQSTPSTSGKTLDTLVKETLAGKYGNGDQRKAALGNQYEAVMAVINGKATVPKKTIDQLAQEVIQGKHGNGEDRKKSLGPDYDAVQKRVTEILKGSTSGNTPKTPSDAPKSEAVNSSTETKTEETEATGKVTEPKIVKEAGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDQQTVKDVGQSDKIEVNIEGIEISINGVTYTLSKKPV

SEQ ID NO: 1721 - protein, 468 aa, Streptococcus suis
MGVNIETAIRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDADNIIHCNYARNGITVDNYNQTAAASGWMYCYVYRLANQTSTSGKSLETLVQETLAGKYGNGDTRKAALGNQYEAVMAVINGKATASQKSIDELAREVIAGKHGNGEARKKSLGSQYEAVQKRVSELLKKQPSEPLKSPEVKQTTEAKTSQTEPTGQATESKEEGDLSFNGAILKKAVLDKILANCKKHDILPSYALTILHYEGLWGTSAVGKADNNWGGMTWTGQGNRPSGVTVTQGSARPSNEGGHYMHYSSVDDFLTDWFYLLRAGGSYKVSGAKTFSEAVKGMFKVGGAVYDYAASGFDSYIVGASSRFKAIESENGTLSKYDIATVTDVGSKDHIDITVDGIEVIINGETYKLEKKPV

SEQ ID NO: 1722 - protein, 481 aa, Streptococcus suis
MAVNSEAAIAWMSARVGKVTYSMDYRNGPGSYDCSSSVYYALMSAGAISAGWAVNTEYEHDWLVKNGYKLIAENQDWDAKRGDIFIWGKRGQSAGAGGHTGIFIDADNIIHCNYAHNGITVNNYNQTAAASGWMYCYVYRLTNQSTPSTSGKTLDTLVKETLAGKYGNGDQRKAALGNQYEAVMAVINGKATAPKKTIDQLAQEVIQGKHGNGEDRKKSLGPDYDAVQKRVTEILKGSTSGNTPKTPSDAPKSEVVNSSTETKTEETEATGKVTEPKIVKEAGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKVGGAVYDYAATGYDNYLVGMSSRLKAIEAENGSLTKYDTATVTDVGSTDKIEINIEGIEISINGVTYTLSKKPV

SEQ ID NO: 1723 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGHSAGAGGHTGIFVDPDNIIHCNYARNGITVDNYNQTAEASGWMYCYVYRLTNQTSTSGKSLETLVQETLAGKYGNGDTRKAALGNQYEAVMAVINGKATSSQKSIDELAQEVIQGKHGNGEARKKSLGSQYEAVQKRVSELLKKQPSEPLKSPEVKQVTETKTSQTEPTGNATVNNEEGDLSFNGAILKKAVLDKILANCKKHDILPSYALTILHYEGLWGTSAVGKADNNWGGMTWTGQGNRPSGVTVTQGSSRPSNEGGHYMHYASVDEFLTDWFYLLRAGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 1724 - protein, 470 aa, Streptococcus suis
MGVNIETALRWMSDRKGRVTYSMDYRNGPNSFDCSSSVYYALMSAGAISAGWAVNTEYEHDWLIKNGCKLIAENTDWDAKRGDIFIWGKRGQSAGAGGHTGIFIDSDNIIHCNYARNGITVDNYNQTAAASGWMYCYVYRLTNQSTPSTSGKTLDALVKETLAGKYGNGDTRKAALGNQYEAVMAVINGKATASQKSIDELAQEVIQGKHGNGETRKKLLGSQYEAVQKRVSELLKKQPSEPSKSPEVKQATESKTSQTEPTGQATESKEEGDLSFNGVILKKAVLDKILTNCKKHDILPSYALTILHYEGLWGTSAVGKTDNNWGGMTWTGQGQRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 1725 - protein, 412 aa, unidentified
  REGION 1..412: note = Bifidobacterium
MRKHKPPWLKRIRLAVTGVVMAITMAVAPAAMADLNGYDVSGYQAPDITQVAPADFAIVKVNQGWYINSSWGQQASGAVNTGKELGLYDYASGMDATTEADNFVNHITGYVGKAMLVLDWEPYQNAAWGNSNWVRTWVYRVHARTGVWPVVYCSKGFVGQIPADVRAKCMLWAAQYANNYATGYQDSPWLAGSQGEGMLQYTSTGYLNGHGPLDLDKFFGDRTAWRKIACGERAGCSTTGGSTGTPNVHVEKRTTNTTDLNAMATAVIRGDYGNGADRQSRLGDNYQAVMNIVNSRLSGSTYSGPTTVTRTTTRTYVVRSGDTVSAIAERTGLKPASAWRVPSGNINRIYVGQTITYYGSSTVSTPSTTYSSTHVVSAGESLWKIYGSGWYAAAQRNGLRPPYTIYPGQRLR

SEQ ID NO: 1726 - protein, 411 aa, unidentified
  REGION 1..411: note = Bifidobacterium
MGRFKNRSKPLQALIAALFAVLLACTPAIAMADTVGIDVSGWQASNVTCTASYDFAVVKVSQGVGFENSSWRTQAKCVTDRGKSLGLYHYAGGNNAEAEADYFVGRARDYIGRAVLVLDWESHQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1727 - protein, 410 aa, Bifidobacterium longum
MGKFKNKSKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQASALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPSGNLNLIYPGQVVTYNGGGSTATAGNAPPATRTVTVRSGDTLSGIAARLGISYTQLSGYRSGNPNVIYPGEVLRY

SEQ ID NO: 1728 - protein, 412 aa, Bifidobacterium breve
MSIKNKSKPSLVTRILAVVVAVLLGVSPATALADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHALTGVWPMVYVQASALGQIPGDVRANCGLWVAQYASNAPTGYQNRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1729 - protein, 411 aa, Bifidobacterium breve
MGRFKNKSKPLQALIAAFVAMLLAATPAIAMADMVGIDVSGWQAANVTCTASYDFAVVKVSQGVGFENGSWRAQAKCVTDRGKSLGLYHYAGGNNAESEADYFVGRARDYIGKAVLVLDWESYQNAQWGNSDWVRRFAQRVHTLTGVWPMVYVQASALGQIPGDVRANCGLWVAQYASNAPTGYQSRPWNYAIYGEAMRQYTSNGWVNGYNGPLDLNYFRGDAGQWQAYANPAGAAKPATPPQTEKPPTQTIDLQALATATIRGDYGNGQQRRDALGANYDRVMAIVNQRLNAGAATQTPQATAPTATRVTVRSGDTMSGIASRTGLWPLSRWSVPSGNLNLIYPGQVVTYNGGGSVATGSNAPPATRTVTVRAGDTLSGIAARLGISYTQLTGYRSGNPNVIYPGEVLRY

SEQ ID NO: 1730 - protein, 252 aa, Trueperella pyogenes
MSYAYITDHDSPNFTPGRPRPPEEITIHHWGAEGQKFDAVVRWLCRPNGSSSSTYVAEGGRVACIVDPDDTPWTNSNFASNQASITIECRPEMSADDFTTVVELVADIRRAYPSIKRIRGHKDHASTACPGKWYGRLFEIWDGASRILGREHAAHTPAPTPAPAGKSIAELADEVLAGKHGNGADRRRSLGAQYDAVQAEVNKRLAPHPAAKSIAQLADEVLAGKHGNGADRRRSLGAQYDAVQAEVNRRLS

SEQ ID NO: 1731 - protein, 411 aa, unidentified
  REGION 1..411: note = Bifidobacterium
MGKIKNKSKPLQALIAAFVAMLLAATPAIAMADMVGIDVSGWQAENVTCTASYDFAVVKVSQGIGFENSSWRTQAKCVTDRGKSLGLYHYAGGNNAEAEADYFVAKARDYIGRAVLVLDWESYQNAQWGNGDWVRRFAQRVHTLTGVWPMVYVQASALRQIPGDVRANCGLWVAQYASNAPTGYQSRPWNYAIYGEAMRQYTSNGWVNGYNGPLDLNYFRGDTSQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1732 - protein, 481 aa, Streptococcus dysgalactiae
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGASGHVVMFVDSDNIIHCNYANNGITINNYNQTATSAGWMYSYVYRLATPATTSTAGKSLDTLVKETLAGNYGNGEMRKAALGNQYDAVMAVINGKSTTAQKSVDQLAQEVIAGKHGNGEGRKKALGSQYDAVQKRVTEMLKTSTSGNTSKTPSEPSNSVVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1733 - protein, 411 aa, unidentified
  REGION 1..411: note = Bifidobacterium
MGRSKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGIWPIVYVQASALNQIPSDVRANCGLWVAQYASNAPTGYQSRPWNYAVYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSKWSVPSGNLNLIYPGQVVTYNGGGSVATGSNAPPATRTVTVRAGDTLSGIAARLGISYTQLTGYRSGNPNVIYPGEVLHY

SEQ ID NO: 1734 - protein, 411 aa, Bifidobacterium breve
MGRFKNRSKPLQALIAALFAVLLACTPAIAMADMVGIDVSGWQASNVTCTASYDFAVVKVSQGVGFENSSWRTQAKCVTDRGKSLGLYHYAGGNNAEAEADYFVGRARDYIGRAALVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1735 - protein, 410 aa, Bifidobacterium longum
MGKFKNKSKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQSSALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNRRLNAGATTQTQQTTSNATRVTVRAGDTMSAIATRTGLWPLSKWSVPSGNLNLIYPGQVVTYNGGGSTATAGNAPPATRTVTVRSGDTLSGIAARLGISYTQLSGYRSGNPNVIYPGEVLRY

SEQ ID NO: 1736 - protein, 410 aa, Bifidobacterium longum
MGRFKNRSKPLQALIAALFAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWRAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSRWSVPSGNLNLIYPGQVVTYNGGGSVATGSNAPPSRTVTVRAGDTLSGIAARLGIGYTQLTGYRSGNPNVIYPGEVLRY

SEQ ID NO: 1737 - protein, 465 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLDQLVKETLAGVHGNGDARKASLGDQYEPVMAVINGKATASEKTVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGSLDKFDKQTVMDVGQSDNIEINVEGIEVIINGETYRLEKKPV

SEQ ID NO: 1738 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVIINGETYKLEKKPV

SEQ ID NO: 1739 - protein, 473 aa, Streptococcus suis
MTINLETSIRWMSDRVGKVSYSMDYRNGPNSYDCSSAVYYALMAGGAISAGWVVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVIINGETYKLEKKPV

SEQ ID NO: 1740 - protein, 411 aa, unidentified
  REGION 1..411: note = Bifidobacterium
MGKIKNKSKPLQALIAAFVAMLLAATPAIAMADMVGIDVSGWQASNVTCTAQYDFAVVKVSQGVGFENGSWRTQARCVTDRGKSLGLYHYAGGNNAASEADYFVGRARDYIGRAVLVLDWESYQNAQWGNSDWVRRFAQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPLTQTVDLQALATATIRGDYGNGQQRRDALGANYDKVMAIVNQRLAGVATVAPQQTTQANTTRVTVRSGDTMSGIASRTGLWPLSRWSVPSGNINRIWPGQVVTYNGGGSVATGGNAPPATRTVTVRAGDTLSGIAARLGISYTQLTGYRSGNPNVIYPGEVLHY

SEQ ID NO: 1741 - protein, 411 aa, Bifidobacterium catenulatum
MGRFKNKSKPLQALIAALFAVLLACTPAIAMADMVGIDVSGWQASNVTCTAQYDFAVVKVSQGVGFENSSWRTQARCVTDRGKSLGLYHYAGGNNAASEADYFVAKARDYVGRAVLVLDWESYQNAQWGNGDWVRRFAQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPQQTTQANTTRVTVRSGDTMSGIASRTGLWPLSRWSVPSGNINRIWPGQVVTYNGGGSVATGGNAPPASRTVTVRAGDTLSDIAARLGISYTQLTGYRSGNPNVIYPGEVLHY

SEQ ID NO: 1742 - protein, 411 aa, Bifidobacterium longum
MGRFKNKSKPLQALIAALFAVLLACTPAIAMADMVGIDVSGWQASNVTCTAQYDFAVVKVSQGVGFENSSWRTQARCVTDRGKSLGLYHYAGGNNAASEADYFVAKARDYVGRAVLVLDWESYQNAQWGNGDWVRRFVQRVHTLTGVWPMVYVQASAIRQIPSDVRANCGLWVAQYASNAPTGYQSRPWNYSIYGEAMRQYTSNGWVNGYNGPLDLNYFRGDAGQWQAYANPAGAAKPATPPQTERPPTQTVDLQALATATIRGDYGNGQQRRDALGANYDRVMAIVNQRLAGVATVAPQQTTQANTTRVTVRSGDTMSGIASRTGLWPLSRWSVPSGNINRIWPGQVVTYNGGGSVATGGNAPPASRTVTVRAGDTLSDIAARLGIGYTQLTGYRSGNPNVIYPGEVLHY

SEQ ID NO: 1743 - protein, 291 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTEKPPTQTIDLQALATATIRGDYGNGQQRRDALGANYDRVMAIVNQRL

SEQ ID NO: 1744 - protein, 412 aa, Bifidobacterium adolescentis
MRKHKPPWLKRFRLAVTGVVMAITMAVAPAAMADLNGYDVSGYQAPDITQVAPADFAIVKVNQGWYINGSWGQQAAGAVNTGKELGLYDYASGMDATTEADNFVNHITGYVGKAMLVLDWEPYQNAAWGNSNWVRTWVYRVHARTGVWPVVYCSKGFVGQIPADIRAKCMLWAAQYANNYATGYQDSPWLAGSQGEGMLQYTSTGYLNGHGPLDLDRFFGDRTAWRKIACGERAGCSTTGGSTGTPNVHVEKRTTNTADLNAMATAVIRGDYGNGADRQARLGDNYQAVMNIVNSRLSGSTYPGPTTVTRTTTRTYVVRSGDTVSAIAERTGLKPASAWRVPSGNINRIYVGQTITYYGLSTVSAPSTTYSSTHVVSAGESLWKIYGTGWYAAAQRNGIRPPYTIYPGQRLR

SEQ ID NO: 1745 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGETRKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1746 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSEASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1747 - protein, 411 aa, Bifidobacterium longum
MGKIKNKSKPLQALIAAFVAMLLAATPAIAMADMVGIDVSGWQAANVTCTASYDFAVVKVSQGVGFENGSWRTQAKCVTDRGKSLGLYHYAGGNNAESEADYFVGRARDYIGKAVLVLDWESYQNAQWGNGDWVRRFAQRVHTLTGVWPMVYVQASALNQIPGDVRANCGLWVAQYASNAPTGYQSRPWNYSIYGEAMRQYTSNGWVSGYNGPLDLNYFRGDAGQWQAYANPAGAAKPATPPQTATPPTQTIDLQALATATIRGDYGNGQQRRDALGANYDKVMAIVNQRLNAGAATQTPQATTSTATRVTVRSGDTMSGIASRTGLWPLSRWSVPSGNINRIWPGQVVTYNGGGSVATGSNAPPATRTVTVRAGDTLSGIAARLGISYTQLTGYRSGNPNVIYPGEVLRY

SEQ ID NO: 1748 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDEYNKVSRGMYYYLYRPINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVGQSDKIEVAIEGIEVTINGTRYKLTKEPI

SEQ ID NO: 1749 - protein, 473 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDEYNKVSRGMYYYLYRPINQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVGQSDKIEVAIEGIEVTINGTRYKLTKEPI

SEQ ID NO: 1750 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRSINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQSDKIEVAIEGIEVTINGTRYKLTKEPI

SEQ ID NO: 1751 - protein, 410 aa, unidentified
  REGION 1..410: note = Bifidobacterium imperatoris
MGKYKNKSKPITALIAAIVAMLLATAPAIAMADMVGIDVSGWQAANVTCTASYDFAVVKVSQGIGFENSSWRTQAKCVTDRGKSLGLYHYAGGNNATSEADYFVAKARDYIGKAVLVLDWESYQNAQWGNSNWVRQFVQRVHTLTGVWPMVYVQASALNQIPSDVRANCGLWVAQYASNAPTGYQSRPWNYSLYGEAMRQYTSNGWISGYNGPLDLNYFRGDASQWQAYANPAGKAQTTTPPQVEKPPTQTVDLQALATATIRGDYGNGQQRRDALGANYDKVMAIVNQRLNAGTTTTQQATTSNTTRVTVRSGDTMSAIATRTGLWPLSKWSVPSGNLNLIYPGQVVAYNGGGSTATAGNAPPATRTVTVRSGDTLSGIAARLGISYTQLTGYRSGNPNVIYPGEVLHY

SEQ ID NO: 1752 - protein, 411 aa, Bifidobacterium breve
MGKIKNRSKPLHALIAALFAVLLACTPAIAMADMVGIDVSGWQASNVTCTASYDFAVVKVSQGVGFENGSWRTQARCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSRWSVPSGNINRIWPGQVVTYNGGGSVATGGNAPPATRTVTVRAGDTLSGIAARLGIGYTQLTGYRSGNPNVIYPGEVLHY

SEQ ID NO: 1753 - protein, 479 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKGSTSGNTPKTPSEPSKTDTVKPQAQPQKAEPGATGKATDTKITKEDGDLSFNGAVLKKAVLDKILANCKEHDILPSYALTILHYEGLWGTSAVGKADNNWGGMTMTSNDLQITRPSGVIVTRGLARPSNEGGHYMHYASVDDFLTDWFYLLRSGGSYKVSGAKTFSEAVKGMFKVGGAVYDYAATGYDNYLVGMSSRLKAIESENGSLAKYDQQTVTDVGQSDKIEVAIEGIEVTINGTRYKLTKEPI

SEQ ID NO: 1754 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAATGYDNYLVGMSSRLKAIEDENGSLAKYDTATVTDVGKTDKIEVAIEGIEVTINGTRYKLTKEPI

SEQ ID NO: 1755 - protein, 464 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPNQPSPSNKSLDQLVKETLAGVHGNGDVRKASLGNQYEAVMAVINGKATTNQKTIDQLAQEVIQGKHGNGEDRKKSLGHDYDAVQKRVTELLKKQPSEPSKVQEVKQPTENKTSQTEPTGQATATKEEGDLSFNGAVLKKDVLDKILANCKKHDILPSYAITVLHFEGLWGTSAVGKADNNWGGMTWAGQGNRPSGVTVTQGSARPSNEGGHYMHYASVDDFLTDWFYLLRSGGSYKVSGAKTFSEAIKGMFKVGGAVYDYAASGFDSYIIGASSRLKAIESENGSLAKYDQQTVTDVGQSDKIEVAIEGIEVTINGTRYRLTKEPI

SEQ ID NO: 1756 - protein, 473 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1757 - protein, 473 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPINQPSTSNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVGQSDKIEVAIEGIEVTINGTRYKLTKEPI

SEQ ID NO: 1758 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDSDNIIHCNYARNGITVDNYNQTAAASGWMYCYVYRLANQTSTSGKSLETLVQETLAGKYGNGDQRKAALGNQYEAVMAVINGKATASQKSIDELAQEVIQGKHGNGETRKKLLGSQYEAVQKRVSELLKKQPSEPSKSPEVKQATESKTSQTEPTGQATETKEEGDLSFNGAILKKAVLDKILANCKKHDILPSYALTILHYEGLWGTSAVGKADNNWGGMTWTGHGNRPSGVTVTQGSARPSNEGGHYMHYASVDDFLTDWFYLLRAGGSYKVSGAKTFSEAVKGMFKVGGAVYDYAASGFDSYIVGASSRLKAIEQENGSLAKYDTATVTDVNQSDDIEINVEGIEVIINGETYKLEKKPV

SEQ ID NO: 1759 - protein, 410 aa, Bifidobacterium breve
MGKFKNKSKPITAIIAAFVAMLLAATPAIAMADIVGIDVSGWQAANVTCTASYDFAVVKVSQGVGFENGSWRAQAKCVTDRGKSLGLYHYAGGNNAASEADYFVAKARDYVGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTATPPTQTIDLQALATATIRGDYGNGQQRRDALGANYDKVMAIVNQRLAGVATVAPQQTTQANTTRVTVRAGDTMSGIASRTGLWPLSRWSVPSGNINRIWPGQVVTYNGGGSVATGSNAPPSRTVTVRAGDTLSGIAARLGISYTQLTGYRSGNPNVIYPGEVLHY

SEQ ID NO: 1760 - protein, 400 aa, unidentified
  REGION 1..400: note = Bifidobacterium
MRILAVVVAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1761 - protein, 410 aa, Bifidobacterium breve
MGRFKNRSKPLQALIAALFAVLLACTPAIAMADMVGIDVSGWQAANVTCTASYDFAVVKVSQGVGFENGSWRAQAKCVTDRGKSLGLYHYAGGNDASSEADYFVAKARDYVGRAVLVLDWESYQNAQWGNSDWVRRFVQRIHTLTGVWPMVYVQASALGQIPGDVRANCGLWVAQYASNAPTGYQNRPWNYSIYGEAMRQYTSNGWISGYNGPLDLNYFRGDAGQWQAYANPAGAAKPATPPQTEKPPTQTIDLQALATATIRGDYGNGQQRRDALGANYDKVMAIVNQRLAGVATVAPQQAAQANTTRVAVRSGDTMSGIASRTGLWPLSRWSVPSGNINRIWPGQVVTYNGGGSVATGSNAPPSRTVTVRAGDTLSGIAARLGIGYTQLTGYRSGNPNVIYPGEVLHY

SEQ ID NO: 1762 - protein, 411 aa, Bifidobacterium breve
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAASEADYFVGRARDYIGRAVLVLDWESYQNAQWGNGDWVRRFAQRVHTLTGIWPMVYVQASALNQIPSDVRANCGLWVAQYASNAPTGYQSRPWNYAIYGEAMRQYTSNGWVNGYNGPLDLNYFRGDASQWQAYANPAGAAKPATPPQTEKPPTQTVDLQALATAAIRGDYGNGQQRRDALGANYDRVMAIVNQRLNGTATVAPQQTTQANTTRVTVRSGDTMSGIASRTGLWPLSKWSVPSGNINRIYPGQVVTYNGGGSVATGSNAPPATRTVTVRSGDTLSGIAARLGIGYTQLTGYRSGNPNVIYPGEVLHY

SEQ ID NO: 1763 - protein, 411 aa, Bifidobacterium breve
MGKIKNKSKPLQALIAAFVAMLLAATPAIAMADMVGIDVSGWQASNVTCTAQYDFAVVKVSQGVGFENGSWRTQARCVTDRGKSLGLYHYAGGNNAASEADYFVGRARDYIGRAVLVLDWESYQNAQWGNSDWVRRFAQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDKVMAIVNQRLAGVATVAPQQTTQANTTRVTVRSGDTMSGIASRTGLWPLSRWSVPSGNINRIWPGQVVTYNGGGSVATGGNAPPATRTVTVRAGDTLSGIAARLGISYTQLTGYRSGNPNVIYPGEVLHY

SEQ ID NO: 1764 - protein, 421 aa, Bifidobacterium pseudocatenulatum
MVNNKDKPWHKRLLAKVTALAAAVCMMLLPATAHADMQGIDVSNWQCGIDIANTQADFVVVGTTWGTGQVNNNCLVSGVNTDANRMIAQAQASGKKFGLYHYAMGGNPEAEAQFFYRNTSNYWRHGIVALDWEMDDNPAWGNWDWVRRFMRECERLSGGVRPLLYTAPVASTIPSDIRAKYGLWIAQYANTSPTGYQASPWMIGVYGEAMRQYSSAGVVNTWSPIDLNIFRGEAWQWDLYSNPAGKTQTTTPPQAEKPPTQTVDLQALATAAIRGDYGNGQQRRDALGANYDRVMAIVNQRLNGTTTVVQRQTTAAATRVTVRSGDTMSGIASRTGLWPLSAWSVPSGNPNLIYPGQVVTYNGGGSIATGSNAPPATRTVTVRSGDTLGGIAARLGIGYTQLTGYHSGNPNLIYPGEVLHY

SEQ ID NO: 1765 - protein, 409 aa, Bifidobacterium longum
MGKFKNKSKPITAIIAAFVAMLLAATPAIAMADIVGIDVSGWQTANVTCTASYDFAVVKVSQGVGFENGSWRAQAKCVTDRGKSLGLYHYAGGNNAEAEADYFVAKARDYVGRAVLVLDWESYQNAQWGNSDWVRRFVQRVHTLTGVWPMVYVQASAIRQIPSDVRANCGLWVAQYASNAPTGYQSRPWNYAIYGEAMRQYTSNGWVSGYNGPLDLNYFRGDAGQWQAYANPAGAAKPATPPPTEKPPTQTIDLQALATATIRGDYGNGQQRRDALGANYDKVMAIVNQRLNGTTTVVQQQTTAAKRVTVRAGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1766 - protein, 408 aa, Bifidobacterium pseudocatenulatum
MGRFKNKSKPLQALIAAFVAMLLAATPAIAMADMVGIDVSGWQAANVTCTASYDFAVVKVSQGVGFENGSWRAQAKCVTDRGKSLGLYHYAGGNNAASEADYFVAKARDYVGRAVLVLDWESYQNAQWGNSDWVRRFVQRVHTLTGVWPMVYVQASAIRQIPSGVRANCGLWVAQYASNAPTGYQSRPWNYSIYGEAMRQYTSNGWVNGYNGPLDLNYFRGDAGQWQAYANPAGAAKPATPPQTATPPTQTIDLQALATATIRGDYGNGQQRRDALGANYDKVMAIVNQRLNGTTTVVQQQTTAATRVTVRAGDTMSGIASRTGLWPLSRWSVPSGNLNLIYPGQVVTYNGGGSVATGSNAPPSRTVTVRAGDTLSGIAARLGIGYTQLTGYRSGNPNVIYPGEVLRY

SEQ ID NO: 1767 - protein, 408 aa, unidentified
  REGION 1..408: note = Bifidobacterium
MGKFKNKSKPITAIIAAFVAMLLAATPAIAMADMVGIDVSGWQAANVTCTASYDFAVVKVSQGVGFENGSWRAQAKCVTDRGKSLGLYHYAGGNNAASEADYFVAKARDYVGRAVLVLDWESYQNAQWGNSDWVRRFVQRVHTLTGVWPMVYVQASAIRQIPSDVRANCGLWVAQYASNAPTGYQSRPWNYSIYGEAMRQYTSNGWVNGYNGPLDLNYFRGDASQWQAYANPAGAAKPATPPQTEKPPTQTIDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1768 - protein, 410 aa, Bifidobacterium breve
MGRFKNRSKPLQALIAALFAVLLACTPAIAMADMVGIDVSGWQASNVTCTASYDFAVVKVSQGVGFENGSWRAQAKCVTDRGKSLGLYHYAGGNNAVSEADYFVAKARDYVGRAVLVLDWESYQNAQWGNSDWVRRFVQRVHTLTGVWPMVYVQASAIRQIPSDVRANCGLWVAQYASNAPTGYQSRPWNYAIYGEAMRQYTSNGWVNGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1769 - protein, 429 aa, unidentified
  REGION 1..429: note = Bifidobacterium samirii
MHHHSTITTSTRGHPPLITRLTGLLLAATVMLTSGVAMADTGMDVSKWQGCVSASAAAQAKAGGAAFAFVKVSEGNGYTDSVADCTMQGLASAGIRRGVYHYARPDLGNTPEAEADWFVSQTRGYIGKGVIPVLDWEPGGSYNTWTWWAKRWLDRVQAAWGVKPLIYMSASVIKAGDWRAVANADYGLWVAGYPAGYTQDRLRDPGAVPYDVSPWKFAAAWQYSSSGRVPGVGDRIDVNWFYGDAATWAKYAGAEHGTNANPTPSTPAETPQQGAPTGDVESLARAVIRGDYGNMPQRRVLLGSRYDEVQARVDQILAGNAPTSQTTGQTAATRVTVRAGDTLSAIAARTGLWPLSAWSVPSGDRNRIYPGQTVVYTGSATTSQAPATSGHVVRAGESLWSIYGTGWSAAAARNGISAPYVIYPGQVLR

SEQ ID NO: 1770 - protein, 411 aa, Bifidobacterium adolescentis
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNGDWVRRFVQRVHTLTGVWPMVYVQASAINQIPSDVRANCGLWVAQYASNAPTGYQSRPWNYAIYGEAMRQYTSNGWVNGYNGPLDLNYFRGDASQWQAYANPAGAAKPVTPPQTEKPPTQTVDLQALATATIRGDYGNGQQRRDALGANYDRVMAIVNQRLAGTATVAPQQTTQSNTTRVAVRSGDTMSGIASRTGLWPLSRWSVPSGNLNLIYPGQVVTYNGGGSVATGGNAPPASRTVTVRSGDTLTGIAARLGISYTQLTGYRSGNPNVIYPGEVLHY

SEQ ID NO: 1771 - protein, 410 aa, unidentified
  REGION 1..410: note = Bifidobacterium
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1772 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGIWPIVYVQASALNQIPSDVRANCGLWVAQYASNAPTGYQSRPWNYAVYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSKWSVPSGNLNLIYPGQVVTYNGGGSVATGSNAPPATRTVTVRAGDTLSGIAARLGISYTQLTGYRSGNPNVIYPGEVLHY

SEQ ID NO: 1773 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFAQRVHTLTGVWPMVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1774 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1775 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVSGYNGPLDLNYFRGDASQWRAYANPAGAAKPATPPQAERPPAQTVDLQALATATIRGDYGNGRQRRDALGANYDKVMAIVNQRLAGTATVAPQQTTQANTTRVTVRSGDTMSGIASRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1776 - protein, 411 aa, Bifidobacterium longum
MGRFKNKSKPLQALIAALFAVLLACTPAIAMADMVGIDVSGWQASNVTCTAQYDFAVVKVSQGVGFENSSWRTQARCVTDRGKSLGLYHYAGGNNAASEADYFVGRARDYIGRAVLVLDWESYQNAQWGNGDWVRRFAQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPQQTTQANTTRVTVRSGDTMSGIASRTGLWPLSRWSVPSGNINRIWPGQVVTYNGGGSVATGGNAPPASRTVTVRAGDTLSDIAARLGISYTQLTGYRSGNPNVIYPGEVLHY

SEQ ID NO: 1777 - protein, 410 aa, Bifidobacterium longum
MGRFKNKSKPLQALIAALIAALLACTPAIAMADMVGIDVSGWQASNVTCTAQYDFAVVKVSQGVGFENSSWRTQARCVTDRGKSLGLYHYAGGNNAASEADYFVGRARDYIGRAVLVLDWESYQNAQWGNGDWVRRFAQRVHTLTGVWPMVYTSAGYLNQLPSDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNINLIYPGQVVTYNGGGSVATGSNAPPATRTVTVRSGDTLSGIAARLGIGYTQLTGYRSGNPNVIYPGEVLHY

SEQ ID NO: 1778 - protein, 410 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGVGYTQLTGYRSGNPNVIYPGEVLHY

SEQ ID NO: 1779 - protein, 411 aa, Bifidobacterium longum
MGKFKNKSKPITAIIAAFVAMLLAATPAIAMADMVGIDVSGWQASNVTCTAQYDFAVVKVSQGVGFENGSWRAQAKCVTDRGKSLGLYHYAGGNNAASEADYFVAKARDYVGRAVLVLDWESYQNAQWGNSDWVRRFVQRVHTLTGVWPMVYVQASAIRQIPSDVRANCGLWVAQYASNAPTGYQSRPWNYAIYGEAMRQYTSNGWVNGYNGPLDLNYFRGDAGQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSRWSVPSGNPNVIYPGQVVTYNGGGSVATGSNAPPATRTVTVRAGDTLSGIAARLGISYTQLTGYRSGNPNVIYPGEVLHY

SEQ ID NO: 1780 - protein, 408 aa, Bifidobacterium longum
MGKIKNKSKPLQALIAAFVAMLLAATPAIAMADMVGIDVSGWQAANVTCTASYDFAVVKVSQGVGFENGSWRTQAKCVTDRGKSLGLYHYAGGNNAEAEADYFVAKARDYVGRAVLVLDWESYQNAQWGNSDWVRRFVQRVHTLTGVWPMVYVQASAIRQIPSDVRANCGLWVAQYASNAPTGYQSRPWNYSIYGEAMRQYTSNGWVNGYNGPLDLNYFRGDAGQWQAYANPAGAAKPATPPQTATPPTQTIDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1781 - protein, 411 aa, Bifidobacterium longum
MGKFKNRSKPLHALIAALFAVLLACTPAIAMADMVGIDVSGWQASNVTCTASYDFAVVKVSQGVGFENSSWRTQAKCVTDRGKSLGLYHYAGGNNAASEADYFVGRARDFVGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRAGDTLSGIAARLGISYTQLTGYRSGNPNVIYPGEVLRY

SEQ ID NO: 1782 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIASRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1783 - protein, 408 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASAIRQIPSDVRANCGLWVAQYASNAPTGYQSRPWNYSIYGEAMRQYTSNGWVNGYNGPLDLNYFRGDAGQWQAYANPAGAAKPATPPQTATPPTQTIDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1784 - protein, 410 aa, Bifidobacterium longum
MGKIKNKSKPLQALIAALFAVLLACTPAIAMADMVGIDVSGWQAANVTCTASYDFAVVKVSQGIGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAIYGEAMRQYTSNGWISGYNGPLDLNYFRGDASQWQAYANPAGAAKPATPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1785 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLAGVATVAPPQTTQANTTRVTVRSGDTMSGIATRTGLWPLSKWSVPSGNLNLIYPGQVVTYNGGGSVATGSNAPPATRTVTVRAGDTLSGIAARLGISYTQLTGYRSGNPNVIYPGEVLHY

SEQ ID NO: 1786 - protein, 411 aa, Bifidobacterium longum
MGRFKNKSKPLQALIAALFAVLLACTPAIAMADMVGIDASGWQASNVTCTASYDFAVVKVSQGVGFENSSWRTQAKCVTDRGKSLGLYHYAGGNNAASEADYFVGRARDYVGRAVLVLDWESYQNAQWGNSDWVRRFVQRVHTLTGIWPIVYVQASALNQIPSDVRANCGLWVAQYASNAPTGYQSRPWNYAVYGEAMRQYTSNGWVNGYNGPLDLNYFRGDASQWQAYANPAGAAKPATPPQTATPPTQTVDLQALATATIRGDYGNGQQRRDALGANYDRVMAIVNQRLAGVATVAPPQTTQANTTRVTVRSGDTMSGIATRTGLWPLSKWSVPSGNLNLIYPGQVVTYNGGGSVATGSNAPPATRTVTVRAGDTLSGIAARLGISYTQLTGYRSGNPNVIYPGEVLHY

SEQ ID NO: 1787 - protein, 411 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFAQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPVTPPPTERPPTQTVDLQALATATIRGDYGNGQQRRDALGANYDRVMAIVNQRLAGVATVAPPQTTQANTTRVTVRSGDTMSGIATRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1788 - protein, 409 aa, Bifidobacterium longum
MGKIKNKSKPLQALIAAFVAMLLAATPAIAMADMVGIDVSGWQASNVTCTAQYDFAVVKVSQGVGFENGSWRTQARCVTDRGKSLGLYHYAGGNNAASEADYFVGRARDYIGRAVLVLDWESYQNAQWGNSDWVRRFAQRVHTLTGIWPIVYVQASALNQIPSDVRANCGLWVAQYASNAPTGYQSRPWNYAIYGEAMRQYTSNGWVNGYNGPLDLNYFRGDAGQWQAYANPAGAAKPATPPQTATPPTQTIDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLRY

SEQ ID NO: 1789 - protein, 408 aa, unidentified
  REGION 1..408: note = Bifidobacterium sp. UTBIF-68
MGKLTKNKSRPAKTLLAMLVAMLLALAPATAMADMVGIDVSGWQAANVTCTAQYDFAVVKVSQGVGFENPSWRTQAKCVNDRGKSLGLYHYAGGNNATAEADYFVGKARDYIGKAVLVLDWESYQNAQWGNSGWVREFVQRIHTLTGVWPMVYVQASALNQIPSDVKANCGLWVAQYASNAPTGYQSRPWNYAIYGEAMRQYTSNGWISGYNGPLDLNYFRGDASQWQAYANPAGKTQTITPPQTEKPPTQTVDLQALAEATIRGDYGNGQQRRDALGANYAAVMAIVNQRLTGTTAGQTPQANTTRVTVRSGDTMSAIATRTGLWPLSKWSVPSGNINRIWPGQVVTYNGGGSIATGSNAPPSRTVTVRSGDTLSGIAARLGISYTQISGYRSGNPNVIYPGEVLRY

SEQ ID NO: 1790 - protein, 400 aa, Bifidobacterium breve
MRILAVVVAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1791 - protein, 171 aa, Bifidobacterium breve
PPQTEKPPTQTVDLQALATATIRGDYGNGQQRRDALGANYDKVMAIVNQRLAGVATVAPQQTTQANTTRVTVRSGDTMSGIASRTGLWPLSRWSVPSGNINRIWPGQVVTYNGGGSVATGGNAPPATRTVTVRAGDTLSGIAARLGISYTQLTGYRSGNPNVIYPGEVLHY

SEQ ID NO: 1792 - protein, 163 aa, Bifidobacterium breve
TQTIDLQALATATIRGDYGNGRQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1793 - protein, 408 aa, Bifidobacterium longum
MGKFKNKSKPITAIIAAFVAMLLAATPAIAMADIVGIDVSGWQAANVTCTASYDFAVVKVSQGVGFENGSWRAQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDAGQWQAYANPAGAAKPATPPQTETPPTQTIDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1794 - protein, 482 aa, unidentified
  REGION 1..482: note = Streptococcus
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLANQNSTPSTSGKTLDTLVKETLAGKYGNGDQRKAALGNQYDAVMAVINGKSTTTQKSVDQLAQEVIAGKHGNGEGRKKALGSQYDAVQKRVTEMLKTSISGNTSKTPSEPSNSVVVNSSTEPKKTETGATGKAADTKITKEDGDLSFNGVVLKKSVLDIILAKCKEHDILPSYAITVLHFEGLWGTSAVGKADNNWGGMTWTGNENRPSGITVTQGSARPSNEGGHYMHYATVDDFLTDWFYLLRAGGSYKVSGAKTFSEAVKGMFKAGGAVYDYAASGYDSYIVGMASRLKAIEQENGPLNKYDQQTDISVGQSDKIDVVIDSLEITINGVTYTATKKPI

SEQ ID NO: 1795 - protein, 481 aa, Streptococcus dysgalactiae
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMVVINGKSTTAQKSVDQLAQEVIAGKHGNGEGRKKALGSQYDAVQKRVTEMLKTSTSGNTSKTPSEPSNSVVVNSSTEPKTEETGATGKATDTKITKEDGDLSFNGAILKKSVLDVILAKCKEHNILPSYAITALHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1796 - protein, 407 aa, Bifidobacterium reuteri
MGKTKNKSRPLKAALAALVATLLALAPATAMADMVGIDVSGWQAANVTCTAQYDFAVVKVSQGVGFENPSWRAQAKCVTDRGKSLGLYHYAGGNNATAEADYFVNRAGDYIGKAVLVLDWESYQNAQWGNSGWVREFVQRIHTLTGVWPMVYVQASALNQIPSDVKANCGLWVAQYASNAPTGYQSRPWNYAIYGEAMRQYTSNGWISGYNGPLDLNYFRGDASQWQAYANPAGKTQTTTPPQTEKPPTQTVDLQALAEATIRGDYGNGQQRRDALGANYAAVMAIVNQRLTGTTAGQTQQANTTRVTVRSGDTMSAIATRTGLWPLSKWSVPSGNINRIWPGQVVTYNGGGGIATGSNAPPSRTVTVRSGDTLSGIAARLGISYTQISGYRSGNPNVIYPGEVLRY

SEQ ID NO: 1797 - protein, 334 aa, unidentified
  REGION 1..334: note = Bifidobacterium sp. WCA-178-WT-4B
QAQASGKRFGLYHYAMGGNPEAEAQFFYANTSNYWRHGIVALDWEMDDNPAWGDWDWVRRFMAECERLSGGVKPLLYTGPVAGAIPGDIRADYGLWIAQYANMSPTGYQADPWMIGAYGEAMRQYSGTGVVNTWSPIDLNLFRGEAWQWDLYANPTGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRAGDTLSGIAARLGIGYTQLTGYRSGNPNVIYPGEVLHY

SEQ ID NO: 1798 - protein, 483 aa, Streptococcus dysgalactiae
MTINTEQAISWMVARQGAVSYSMDYRNGPSSYDCSSAIYYALMSAGAISAGWAVNTEYMHDWLIKNGYKLIAENQDWDAKRGDIFIWGKRGQSAGAGGHTGIFVDPDNIIHCNYANNSITINNYNQTAAASGWMYCYVYRLINQASTPSTSGKTLDTLVKETLAGKYGNGDTRKAALGNQYEAVMAVINSKATTPKKSIDQLAQEVIQGKHGNGEERKKSLGSDYEPVQKRVTEILKNSTSGNAPKTPSEPSKSEVVNSTTQPQTGETGAIGKATEPKITKEAGDLSFNGAILKKSVLDVILKKCQEHNILPSYAITCLHFEGLWGTSAVGKADNNWGGMTWTGNGNRPSGVIVTQGSARPSNEGGHYMRYASVDDFLTDWFYLLRSGGSYKVSGAKTFSEAVKGMFKTGGAVYDYAATGYDNYLVGMASRLKAIEAENGSLTKYDLIPDSPSSLQPDKINITIEGIEISINGVTYELTKKPV

SEQ ID NO: 1799 - protein, 410 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPVTPPQTEKPPTQTIDLQALATATIRGDYGNGQQRRDALGANYDKVMAIVNQRLGSATVATQQAAQANTTRVAVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1800 - protein, 265 aa, unidentified
  REGION 1..265: note = Canibacter zhoujuaniae
MVISKHAAGTVPHHNKINYRGAAKIQYVIVHHWAGTHGGDSRLLNPHEQVSANYIVYSDGRIIQQVPEEYRAWTSGHSIDFQAITIETQNSATGGVWPVTDAAQRALEKLIGDIGARYWAGRVERWRVRGHREFAATACPGEFLWARLGAIADAANKLAGGTPLPKPKPVHKLTLQQVAQQVIRGNWGNGADRVSRLRTAGYDPAKVQAEVNRQLGTGTAPKPDIAKIAREVIAGKYGNGEERRRRLGGLYPLVQAEVNRQLGLR

SEQ ID NO: 1801 - protein, 481 aa, Streptococcus dysgalactiae
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMVVINGKSTTAQKSVDQLAQEVIAGKHGNGEGRKKALGSQYDAVQKRVTEMLKTSTSGNTSKTPSEPSNSVVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSDAVKGMFKVGGSVYDYAASGFDSYIVGASSRLKAIEQENGSLDKFDKATDIGVGSKDQIDITIAGIEVTINGITYELTKKPV

SEQ ID NO: 1802 - protein, 346 aa, Streptococcus canis
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLANQNSTPSTSGKTLDTLVKETLAGKYGNGDQRKAALGNQYDAVMAVINGKSTTTQKSVDQLAQEVIAGKHGNGEGRKKALGSQYDAVQKRVTEMLKTSISGNTSKTPSEPSNSVVVNSSTEPKKTETGATGKAADTKITKEDGDLSFNGVVLKKSVLDIILAKCKEHNILPSYAITVLHFEGLWGTSAVGKADNNWGGMTWTGKG

SEQ ID NO: 1803 - protein, 411 aa, Bifidobacterium longum
MGKIKNRSKPLHALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGKAVLALDWESYQNAQWGNSDWVRRFVQRVHTLTGVWPMVYVQASALNQIPSDVRANCGLWVAQYASNAPTGYQSRPWNYSIYGEAMRQYTSNGWVNGYNGPLDLNYFRGDASQWRAYANPAGAAKPATPPQAERPPAQTVDLQALATATIRGDYGNGQQRRDALGANYDKVMAIVNQRLNGGATVATQQTTQANTTRVTVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1804 - protein, 411 aa, Bifidobacterium longum
MGRFKNKSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRAGDTLSGIAARLGISYTQLTGYRSGNPNVIYPGEVLHY

SEQ ID NO: 1805 - protein, 411 aa, Bifidobacterium longum
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1806 - protein, 411 aa, unidentified
  REGION 1..411: note = Bifidobacterium
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTEKPPTQTIDLQALATATIRGDYGNGQQRRDALGANYDRVMAIVNQRLAGVATVAPQQTTQANTTRVTVRSGDTMSGIATRTGLWPLSRWSVPSGNLNLIYPGQVVTYNGGGSVATGSNAPPATRTVTVRSGDTLSGIAARLGISYTQLTGYRSGNPNVIYPGEVLHY

SEQ ID NO: 1807 - protein, 411 aa, Bifidobacterium longum
MGKFKNKSKPITAIIAAFVAMLLAATPAIAMADMVGIDVSGWQAANVTCTASYDFAVVKVSQGVGFENSSWRAQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQTTQANTTRVTVRSGDTMSGIASRTGLWPLPKWSVPSGNLNLIYPGQVVTYNGGGSVATGGNAPPATRTVTVRAGDTLSGIAARLGISYTQLTGYRSGNPNVIYPGEVLHY

SEQ ID NO: 1808 - protein, 410 aa, Bifidobacterium pseudocatenulatum
MGKFKNKSKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQSSALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPGGNLNLIYPGQVVTYNGGGSTATAGNAPPATRTVTVRSGDTLSGIAARLGISYTQLSGYRSGNPNVIYPGEVLRY

SEQ ID NO: 1809 - protein, 410 aa, Bifidobacterium longum
MGKIKNKSKPLQALIAALFAVLLACTPAIAMADMVGIDVSGWQAANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPQTEKPPTQTIDLQALATATIRGDYGNGQQRRDALGANYDKVMAIVNQRLGSATVAPQQAAQANTTRVAVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1810 - protein, 410 aa, Bifidobacterium adolescentis
MGKFKNKSKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQASALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPGGNLNLIYPGQVVTYNGGGSTATAGNAPPATRTVTVRSGDTLSGIAARLGISYTQLSGYRSGNPNVIYPGEVLRY

SEQ ID NO: 1811 - protein, 410 aa, Bifidobacterium longum
MGRFKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1812 - protein, 411 aa, Bifidobacterium longum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAVYGEAMRQYTSNGWVNGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1813 - protein, 408 aa, Bifidobacterium longum
MGKIKNKSKPLQALIAAFVAMLLAATPAIAMADMVGIDVSGWQASNVTCTAQYDFAVVKVSQGVGFENGSWRTQARCVTDRGKSLGLYHYAGGNNAASEADYFVGRARDYIGRAVLVLDWESYQNAQWGNSDWVRRFAQRVHTLTGIWPIVYVQASALNQIPSDVRANCGLWVAQYASNAPTGYQSRPWNYAIYGEAMRQYTSNGWVNGYNGPLDLNYFRGDAGQWQAYANPAGAAKPATPPQTATPPTQTIDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLRY

SEQ ID NO: 1814 - protein, 411 aa, Bifidobacterium longum
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNGDWVRRFAQRVHTLTGIWPMVYVQASALNQIPSDVRANCGLWVAQYASNAPTGYQSRPWNYAIYGEAMRQYTSNGWVNGYNGPLDLNYFRGDASQWQAYANPAGAAKPATPPQTEKPPTQTVDLQALATAAIRGDYGNGQQRRDALGANYDKVMAIVNQRLAGTATVAPQQAAQANTTRVTVRSGDTMSGIASRTGLWPLSKWSVPSGNINRIYPGQVVTYNGGGSVATGSNAPPATRTVTVRSGDTLSGIAARLGIGYTQLTGYRSGNPNVIYPGEVLHY

SEQ ID NO: 1815 - protein, 411 aa, Bifidobacterium longum
MGRFKNKSKPLQALIAALFAVLLACTPAIAMADMVGIDVSGWQASNVTCTAQYDFAVVKVSQGVGFENSSWRTQARCVTDRGKSLGLYHYAGGNNAASEADYFVGRARDYIGRAVLVLDWESYQNAQWGNGDWVRRFAQRVHTLTGIWPIVYVQASALNQIPSDVRANCGLWVAQYASNAPTGYQSRPWNYAIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLASVATVAPQQTTQANTTRVTVRSGDTMSGIASRTGLWPLSRWSVPSGNINRIWPGQVVTYNGGGSVATGGNAPPASRTVTVRAGDTLSDIAARLGISYTQLTGYRSGNPNVIYPGEVLHY

SEQ ID NO: 1816 - protein, 468 aa, unidentified
  REGION 1..468: note = Streptococcus
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDQRKAALGNQYEAVMAVINSKATASQKSIDELAQEVIQGKHGNGETRKKLLGSQYEAVQKRVSELLKKPPSEPSKSPEVKQATESKTSQTEPTGQATESKEEGDLSFNGAILKKAVLDKILAKCKEHDILPSYALTILHYEGLWGTSAVGKTDNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 1817 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSAEPKIEETEPTGQATESKEDGDLFFNGAILKKSVLDVILAKCKKHDILPSYAITVLHFEGLWGTSAVGKVDNNWGGMTMTSNDLQITRPSGVIVTRGLARPSNEGGHYMHYASVDDFLTDWFYLLRSGGSYKVSGAKTFSEAVKGMFKVGGAVYDYAATGYDNYLVGMSSRLKAIESENGSLAKYDQQTVTDVGQSDKIEVAIEGIEVTINGTRYKLTKEPI

SEQ ID NO: 1818 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTIIHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 1819 - protein, 410 aa, Bifidobacterium longum
MGKIKNKSKPLQALIAALFAVLLACTPASAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1820 - protein, 410 aa, Bifidobacterium pseudocatenulatum
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPVTPPPTEKPPTQTVDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRSGDTLSGIAARLGIGYTQLTGYRSGNPNVIYPGEVLHY

SEQ ID NO: 1821 - protein, 92 aa, Eggerthella sinensis
MARHAIAGEFGNGDARRASPGARYDEVRAEVNQVLSGGDASGGGVSGVGCDLDGFARRAINGDYGSGEARRERLGAVYEAVQRRVNELLRKR

SEQ ID NO: 1822 - protein, 409 aa, Bifidobacterium longum
MGRFKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYTSAGYLNQLPSDVRANCGLWVAQYASNAPTGYQSRPWNYAVYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPSRTVTVRAGDTLSGIAARLGIGYTQLTGYRSGNPNVIYPGEVLRY

SEQ ID NO: 1823 - protein, 126 aa, Bifidobacterium breve
MGLWASGYNGPLDLNYFRGDASQWQAYANPAGKTQTTTPPQTEKPPTQTVDLQALATATIRGDYGNGRQRRDALGANYDKVMAIVNQRLNNAGTSQTQQQATSTGVTSVTIRSGDAMSAIATRTGL

SEQ ID NO: 1824 - protein, 465 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLAQLVKETLAGVHGNGDARKASLGDQYEPVMAVINGKATASEKTVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGSLDKFDKQTVMDVGQSDNIEINVEGIEVIINGETYRLEKKPV

SEQ ID NO: 1825 - protein, 465 aa, Streptococcus suis
MTINLETSIRWMSDRVGKVSYSMDYRNGPNSYDCSSAVYYALMAGGAISASWAVNTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLDQLVKETLAGVHGNGDARKASLGDQYEPVMAVINGKATASEKTVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGSLDKFDKQTVMDVGQSDNIEINVEGIEVIINGETYRLEKKPV

SEQ ID NO: 1826 - protein, 126 aa, unidentified
  REGION 1..126: note = Bifidobacterium
MGLWASGYNGPLDLNYFRGDASQWQAYANPAGKTQTTTPPQTEKPPTQTVDLQALATATIRGDYGNGRQRRDALGANYDKVMAIVNQRLNNAGTSQTQQQATSTGVTSVTIRSGDTMSAIATRTGL

SEQ ID NO: 1827 - protein, 476 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKGSTSGNTPKTPSEPSKTDTVKPQAQPQKAEPGATGKATDTKITKEDGDLSFNGAVLKKAVLDKILANCKEHDILPSYALTILHYEGLWGTSAVGKADNNWGGMTWTGKGERPSGVTVTQGSARPASEGGNYMHYATVDDFLTDWFYLLRSGGSYKVSGAKTFSEAVKGMFKVGGAVYDYAATGYENYLVGMSSRLKAIESENGSLAKYDQQTVTDVGSSDKIEVNIEGIEISINGVTYTLSKKPV

SEQ ID NO: 1828 - protein, 410 aa, Bifidobacterium adolescentis
MGKFKNKSKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQASALNQIPSDVRANCGLWVAQYASNAPTGYQSRPWNYSIYGEAMRQYTSNGWVSGYNGPLDLNYFRGDAPQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPSGNLNLIYPGQVVTYNGGGSTATAGNAPPATRTVTVRSGDTLSGIAARLGISYTQLSGYRSGNPNVIYPGEVLRY

SEQ ID NO: 1829 - protein, 391 aa, Bifidobacterium longum
MLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPATPPQTEKPPTQTIDLQALATATIRGDYGNGQQRRDALGANYDRVMAIVNQRLAGVATVAPQQTTQANTTRVTVRSGDTMSGIATRTGLWPLSRWSVPSGNLNLIYPGQVVTYNGGGSVATGSNAPPATRTVTVRSGDTLSGIAARLGISYTQLTGYRSGNPNVIYPGEVLRY

SEQ ID NO: 1830 - protein, 481 aa, Streptococcus suis
MAVNIEAAIAWMSARVGKVTYSMDYRNGPGSYDCSSSVYYALMSAGAISAGWAVNTEYEHDWLTKNGYKLIAENQDWDAKRGDIFIWGRRGQSSGAGGHTGIFIDPDNIIHCNYANNSITINNYNHTAAASGWMYCYVYRLANQSTPSTSGKTLDTLVKETLAGKYGNGDQRKAALGNQYEAVMAVINGKATAPKKTIDQLAQEVIQGKHGNGEDRKKSLGPDYDAVQKRVTEILKGSTSGNAPKTPSNTPKSEVVNSTIEPKKAETGATGKATDTKITKEDGDLSFNGAILKKSVLDVILAKCKEHDILPSYAITVLHFEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGYDNYLVGMSSRLKAIEAENGSLTKYDTATVTDVGSTDKIEVNIEGIEISINGVTYTLSKKPV

SEQ ID NO: 1831 - protein, 468 aa, Streptococcus suis
MGVNIETAIRWMSDRKGRVTYSMDYRNGPNSFDCSSSVYYALMSAGAISAGWAVNTEYEHDWLIKNGYKLIAENADWDAKRGDIFIWGRRGQSAGAGGHTGIFIDSDNIIHCNYARNGITVDNYNQTAAASGWMYCYVYRLANQTSTSGKSLETLVQETLAGKYGNGDTRKAALGNQYEAVMAVINGKATASQKSIDELAQEVIQGKHGNGEARKKSLGSQYEAVQKRVSELLKKQPSEPSKSPEVKQITESKTSQTEPTRQATESKEEGDLSFNGAILKKAVLDKILANCKKHDILPSYALTILHYEGLWGTSAVGKADNNWGGMTWTGQGNRPSGVTVTQGSSRPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 1832 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGHSAGAGGHTGIFVDPDNIIHCNYARNGITVDNYNQTAAASGWMYCYVYRLANQTSTSGKSLETLVQETLAGKYGNGDQRKAALGNQYEAVMAVINGKATASQKSIDELAQEVIQGKHGNGETRKKLLGSQYEAVQKRVSELLKKPPSEPSKSPEVKQATESKTSQTEPTGQTTESKEEGDLSFNGALLRKAVLDKILAKCKEHDILPSYALTILHYEGLWGTSAVGKTDNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 1833 - protein, 468 aa, Streptococcus suis
MGVNIETAIRWMSDRKSRVTYSMDYRNGPNSFDCSSSVYYALMSAGAISAGWAVNTEYEHDWLIKNGYTLIAENTDWDAQRGDIFIWGRRGQSAGAGGHTGIFIDADNIIHCNYARNGITVDNYNQTAAASGWMYCYVYRLANQTSTSGKSLETLVQETLAGKYGNGDTRKAALGNQYEAVMAVINGKATASQKSIDELAQEVIAGKHGNGEARKQALGSQYEAVQKRVSELLKKQPSEPSMSPEVKQTTEAKTSQTEPTGQATESKEEGDLSFNGAILKKAVLDKILANCKKHDILPSYALTILHYEGLWGTSAVGKADNNWGGMTWTGQGNRPSGIIVTQGSARPSNEGGHYMHYASVDDFLTDWFYLLRAGGSYEVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 1834 - protein, 369 aa, unidentified
  REGION 1..369: note = Granulicatella sp. zg-ZJ
MHTGLVIEDSDGYTIKTIEQNVDGNADSLTVGGVARYRERSFDGIVGWIRPPYNKNESVKTTDINEVAQQVLNGLWGNGAERTELLKKAGYNVEDVQAKVNSLLGYNTNENERSIDELAQDVIDGKLGNGEQRKQALGDKYDAVQAKVNELLTKREDVPASEPENKSDGVLNYKGSSLSQEVLDKIIALCKHYDILPSYAITVLHFEGLWGTSNVGIIDNNWAGMTMPDGKETVVRDSGVTVTKGSARRQIEGGYYMHYETVDDFLKDWFHLMRNGYMYCVSGVKSFSECVKGMFKVGGSYYDYAATGYENYLIGMTSRLAEIEKVNGSLSKYDDMIYKKEEVKHDKIEIVFENIEVNINGVPYILKKK

SEQ ID NO: 1835 - protein, 481 aa, Streptococcus dysgalactiae
MAIETEKAISWMVSRQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMAVINGKSTTAQKSVDQLAQEVIAGKHGNGEGRKKALGSQYDAVQKRVTEMLKGSTSGNTPKTPSDAPKSEVVNSSAETKTEETEATGKVTEPKIAKEVGDLSFNGAILKKSVLDVILAKCKEHNILPSYAITVLHFEGLWGTSAVGKGDNNWGGMTWNGTENRPSGITVTQGTARPAVEGGHYMHYASVDDFLTDWFYLLRAGGSYKVSGANTLSEAIKGMFIVGGAKYDYASIGYENYLVGASSRLKAIETENGSLSKFDTATLEDVGSKDKIDITIAGIEVTINGITYELTKKPV

SEQ ID NO: 1836 - protein, 454 aa, Streptococcus suis
MGVNIETALHWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDSDNIIHCNYARNGITVDNYNQTAAASGWMYCYVYRLANQTSTTGKSLETLVQETLAGKYGNGDTRKAALGNQYEAVMSVINGKATASQKSIDELAQEVIQGKHGNGEERKKSLGSQYEAVQKHVSELLKKQPSEPPKSPEVKQTTESKEEGDLSFNGAILKKAVLDKILDNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSESVKGMFKVGGAVYDYAASGFDSYIVGASSRLKAIESENGSLDKFDKLTVTDVGSKDHIDITVDGIEVIINGETYKLEKKPV

SEQ ID NO: 1837 - protein, 289 aa, unidentified
  REGION 1..289: note = Adlercreutzia agrestimuris
MATYIGQASCDENVRYVEGQAGNQTGTELNTRAAYLYNWHSLIRFRDPAKALKCGQAMAAAVSNMKNGYDQGERNTILPLARAAGWGLSKITTACECDCSSLAGICGIAARIPESYIYKDGNLCYTGNQVACFEASGIVDVYSTSDYANSTVKWQVGDILVSNSHTVVVVSGNAPSGSGTATAVSGDIDELAQVVIAGRYGNGDARRAALGDKFNAVQKRVNQLLSGTVSAAGTSTGVARIIAGEYKVVASSLNVRDKPSLSGSKVASYSYGEHIYSIAADTVTADGYV

SEQ ID NO: 1838 - protein, 390 aa, Bifidobacterium longum
MLLACTPAIAMADMVGIDVSGWQAANVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGIWPMVYVQASALNQIPSDVRANCGLWVAQYASNAPTGYQSRPWNYSIYGEAMRQYTSNGWVNGYNGPLDLNYFRGDASQWQAYANPAGAAKPATPPQTERPPTQTVDLQALATATIRGDYGNGQQRRDALGANYDRVMAIVNQRLGSATVVPQQTTQANTTRVTVRSGDTMSGIASRTGLWPLSRWSVPSGNLNLIYPGQVVTYNGGGSVATGSNAPPATRTVTVRAGDTLSGIAARLGISYTQLTGYRSGNPNVIYPGEVLHY

SEQ ID NO: 1839 - protein, 410 aa, Bifidobacterium breve
MGKFKNKGKPITAIIAAIIAMLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQASALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPSGNLNLIYPGQVVTYNGGGSTATAGNAPPATRTVTVRSGDTLSGIAARLGISYTQLSGYRSGNPNVIYPGEVLRY

SEQ ID NO: 1840 - protein, 411 aa, Bifidobacterium pseudocatenulatum
MGKIKNKSKPLQALVAAFVAMLLAATPAIAMADMVGIDVSGWQAANVTCTASYDFAVVKVSQGVGFENGSWRAQARCVTDRGKSLGLYHYAGGNNAEAEADYFVGRARDYIGKAVLVLDWESYQNAQWGNSDWVRRFVQHVHALTGVWPMVYVQASALNQIPGDVRANCGLWVAQYASTAPTGYQSRPWNYAIYGEAMRQYTSNGWVSGYNGPLDLNYFRGDAGQWQAYANPAGAAKPATPPQTATPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1841 - protein, 410 aa, Bifidobacterium breve
MGRFKNKSKPLQALIAALFAVLLACTPAIAMADMVGIDVSGWQASNVTCTASYDFAVVKVSQGVGFENSSWRTQAKCVTDRGKSLGLYHYAGGNNAASEADYFVGRARDYIGRAVLVLDWESYQNAQWGNSDWVRRFVQRVHTLTGVWPMVYVQASALNQIPSDVRANCGLWVAQYASNAPTGYQSRPWNYSIYGEAMRQYTSNGWVNGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLCY

SEQ ID NO: 1842 - protein, 411 aa, Bifidobacterium breve
MGRFKNRSKPLQALIAALFAVLLACTPAIAMADTVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1843 - protein, 411 aa, Bifidobacterium pseudocatenulatum
MGKIKNKSKPLQALIAAFVAMLLAATPAIAMADMVGIDVSGWQASNVTCTAQYDFAVVKVSQGVGFENSSWRTQARCVTDRGKSLGLYHYAGGNNAASEADYFVAKARDYVGRAVLVLDWESYQNAQWGNGDWVRRFVQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTERPPTQTVDLQALATATIRGDYGNGQQRRDALGANYDRVMAIVNQRLAGVATVAPQQAAQANTTRVAVRSGDTMSGIASRTGLWPLSRWSVPSGNLNLIYPGQVVTYNGGGSVATGSNAPPATRTVTVRAGDTLSGIAARLGIGYTQLTGYRSGNPNVIYPGEVLHY

SEQ ID NO: 1844 - protein, 468 aa, Streptococcus suis
MGVNIETALRWMSDRKGRVTYSMDYRNGPNSFDCSSSVYYALMSAGAISAGWSVNTEYEHDWLIKNGCKLIAENTDWDAKRGDIFIWGKRGQSAGAGGHTGIFIDSDNIIHCNYARNGITVDNYNQTAAASGWMYCYVYRLANQTSTSGKSLETLVQETLAGKYGNGDTRKAALGNQYEAVMAVINGKATASQKSIDELAQEVIAGKHGNGEARKQALGSQYEAVQKRVSELLKKQPSEPSMSPEVKQTTEAKTSQTEPTGQATESKEEGDLSFNGAILKKAVLDKILANCKKHDILPSYALTILHYEGLWGTSAVGKADNNWGGMTWTGQGNRPSGVTVTQGSTRPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 1845 - protein, 481 aa, Streptococcus suis
MAVNIEVAIAWMSARVGKVTYSMDYRNGPGSYDCSSSVYYALMSAGAISAGWAVNTEYEHDWLIKNGYKLIAENQDWDAKRGDIFIWGRRGQSAGAGGHTGIFVDPDNIIHCNYANNSITINNYNQTAAAGGWMYCYVYRLANQSTPSTSGKTLDTLVKETLAGKYGNGDQRKAALGNQYEAVMAVINGKATVPKKTIDQLAQEVIQGKHGNGEDRKKSLGPDYDAVQKRVTEILKGSTSGNTPKTPSDAPKSKVVNSSTETKTEETEATGKVTEPKIVKEAGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLTKYDTATVNNVGSTDKIEVNIEGIEISINGVTYTLSKKPV

SEQ ID NO: 1846 - protein, 410 aa, Bifidobacterium breve
MGRFKNRSKPLQALIAALFAVLLACTPAIAMADMVGIDVSGWQAANVTCTASYDFAVVKVSQGVGFENGSWRTQAKCVTDRGKSLGLYHYAGGNNAEAEADYFVGRARDYIGRAVLVLDWESYQNAQWGNSDWVRRFVQRIHTLTGVWPMVYVQASALGQIPGDVRANCGLWVAQYASNAPTGYQNRPWNYSIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSGATGSNAPPSRTVTVRAGDTLSGIAARLGIGYTQLTGYRSGNPNVIYPGEVLHY

SEQ ID NO: 1847 - protein, 411 aa, Bifidobacterium catenulatum
  SITE 231: note = misc_feature - Xaa can be any naturally occurring amino acid
MGRFKNRSKPLQALIAALFAVLLACTPAIAMADMVGIDVSGWQGSNVTCTASYDFAVVKVSQGVGFENSSWRTQAKCVTDRGKSLGLYHYAGGNNAEAEADYFVGRAMDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYAXPAGAAKPATPPQTEKPPTQTIDLQALATATIRGDYGNGQQRRDALGANYDKVMAIVNQRLAGTATVAPQQAAQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1848 - protein, 411 aa, Bifidobacterium catenulatum
MGRFKNKSKPLQALIAALFAVLLACTPAIAMADMVGIDVSGWQASNVTCTAQYDFAVVKVSQGVGFENSSWRTQAKCVTDRGKSLGLYHYAGGNNAASEADYFVGRARDYIGRAVLVLDWESYQNAQWGNGDWVRRFAQRVHTLTGVWPMVYVQASALGQIPGDVRANCGLWVAQYASNAPTGYQSRPWNYAIYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGAATVAPPQTTQANTTRVTVRSGDTMSGIASRTGLWPLSKWSVPSGNLNLIYPGQVVTYNGGGSVATGSNAPPATRTVTVRSGDTLSGIAARLGISYTQLTGYRSGNPNVIYPGEVLHY

SEQ ID NO: 1849 - protein, 481 aa, Streptococcus canis
MAIETEKAISWMVARQGAVSYSMDYRNGPSSYDCSSAIYYALMSAGAISAGWAVNTEYMHDWLIKNGYVLIAENQDWNSQRGDVVIWGLRGQSAGAGGHVVMFVDSDNIIHCNYANNGITINNYNQTAASAGWMYSYVYRLATPATTSTAGKSLDTLVKETLAGNYGNGEMRKAALGNQYDAVMAVINGKSTTAQKSIDELAKEVIAGKHGNGEDRKKAIGSQYDAVQKRVTEMLKTSPSGNASKTSSDAPKSEVANSTVVPQKAETGATGKATEPKITKEPGDLSFNGAILKKSVLDVILKKCQEHNILPSYAITCLHFEGLWGTSAVGKADNNWGGMTWTGQGNRPSGVTVTQGSARPSNEGGHYMRYASVDDFLTDWFYLLRSGGSYKVSGAKTFSEAVKGMFKAGGAKYDYAASGYDSYIVGMASRLKAIEQENGPLNKYDQQTDISVGQSDKIDVVIDSLEITINGVTYTATKKPI

SEQ ID NO: 1850 - protein, 252 aa, Trueperella pyogenes
MSYAYITDHDSPNFTPGRPRPPEEITIHHWGAEGQKFDAVVRWLCRPNGSSSSTYVAEGGRVACIVDPDDTPWTNSNFASNQASITIECRPEMSADDFTTVVELVADIRRAYPSIKRIRGHKDHASTTCPGKWYGRLFEIWDGASRILGREHAAHTPAPTPAPAGKSIAELADEVLAGKHGNGADRRRSLGAQYDAVQAEVNKRLAPHPAAKSIAQLADEVLAGKHGNGADRRRSLGAQYDAVQAEVNRRLS

SEQ ID NO: 1851 - protein, 410 aa, Bifidobacterium longum
MGKIKNKSKPLQALIAALFAVLLACMPAIAMADMVGIDVSGWQAANVTCTASYDFAVVKVSQGIGFENSSWRTQAKCVTDRGKSLGLYHYAGGNSATAEADYFISLVRDYIGRAVLVLDWESYQNAQWGNSNWVRAFAQRIHTLTGVWPMVYTSAGYLNQLPSDVRANCGLWVAQYASNAPTGYQSRPWNYSIYGEAMRQYTSNGWISGYNGPLDLNYFRGDASQWQAYANPAGAAKPVTPPPTEKPPTQTIDLQALATATIRGDYGNGQQRRDALGANYDKVMAIVNQRLGSATVATQQTTQANTTRVTVRSGDTMSGIASRTGLWPLSRWSVPSGNLNLIYPGQVVTYNGGGSVATGSNAPPATRTVTVRAGDTLSGIAARLGISYTQLTGYRSGNPALIYPGEVLHY

SEQ ID NO: 1852 - protein, 410 aa, Bifidobacterium longum
MGKIKNKSKPLQALIAAFVAMLLAATPAIAMADMVGIDVSGWQAANVTCTASYDFAVVKVSQGVGFENGSWRAQAKCVTDRGKSLGLYHYAGGNNAASEADYFVAKARDYVGRAVLVLDWESYQNAQWGNSDWVRRFVQRVHTLTGVWPMVYVQASAIRQIPSDVRANCGLWVAQYASNAPTGYQSRPWNYAIYGEAMRQYTSNGWVSGYNGPLDLNYFRGDAGQWQAYANPAGAAKPVTPPQPEKPPTQTIDLQALATATIRGDYGNGQQRRDALGANYDKVMAIVNQRLNAGAATQTPQAATSTATRVTVRSGDTMSGIASRTGLWPLSRWSVPSGNINRIWPGQVVTYNGGGSVATGSNAPPSRTVTVRAGDTLSGIAARLGISYTQLTGYRSGNPNVIYPGEVLHY

SEQ ID NO: 1853 - protein, 92 aa, Eggerthella sinensis
MARHAIAGEFGNGDARRAPPGARYDEVRAEVNQVLSGGDASGGGVSGVGCDLDGFARRAINGDYGSGEARRERLGAVYEAVQRRVNELLRKR

SEQ ID NO: 1854 - protein, 414 aa, unidentified
  REGION 1..414: note = uncultured Bifidobacterium sp.
MRKHKPPWLKRFRLAVTGVVMAITMAVAPAAMADLNGYDVSGYQAPDITQVAPADFAIVKVNQGWYINSSWGQQASGAVNTGKELGLYDYASGMDATTEADNFVNHITGYVGKAMLVLDWEPYQNAAWGNSNWVRTWVYRVHARTGVWPVVYCSKGFVGQIPADVRAKCMLWAAQYANNYATGYQDSPWLAGSQGEGMLQYTSTGYLNGRGPLDLDKFFGDRTAWRKIACGERAGCSTTGGSTGTPTIHVEKRTTNTTDLNAMATAVIRGDYGNGADRQARLGDNYQAVMNIVNSRLSSSAYSGPTTVTRTKTRTYVVRSGDTVSAIAERTGLKPASAWRVPSGNINRIYVGQTITYYGSSTVSTPSTTYYGSSTHVVSSGESLWKIYGAGWYAAAQRNGLRPPYTIYPGQRLR

SEQ ID NO: 1855 - protein, 465 aa, Streptococcus suis
MTINLETSIRWMNDRVGKVSYLMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPRISNKSLDQLVKETLAGVHGNGDARKASLGNQYEPVMAVINGKATTSQKSVDQLAQEVIAGKHGNGEARKKSLGSQYDAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYTSVDDFLTDWFYLLRANGSYKVSGAKTFSEAVKGMFKVGGAVYDYAASGFDSYIVGASSRLKAIESENGTLSKYDTATVTDVGSKDHIDITIDGIEVTINGTRYRLTKEPI

SEQ ID NO: 1856 - protein, 470 aa, unidentified
  REGION 1..470: note = Streptococcus parasuis
MGVNIETAIAWMEARRGKVTYSMDYRNGPNSYDCSSAVYYALMAGGAISAGWAVNTEYEHDWLTKNNFKLIAENTDWDAKRGDIFIWGKRGQSSGAGGHTGIFVDPDNIIHCNYARNGITVDNYNQTAAASGWMYCYVYRLANQSTPSTSGKTLDTLVKETLAGKYGNGDQRKASLGNQYEAVMAVINGKATASQKSIDELAQEVIAGKHGNGEARKKSLGSQYEAVQKRVTELLKKQPSEPSKVQEVKQPTATKTSQTEPIEKATVSKEEGDLSFNGAILKKAVLDKVLANCKKHDILPSYAITVLHFEGLWGTSAVGKADNNWGGMTWTGQGNRPSGVTVTQGSARPSNEGGHYMHYATVDDFLTDWFYLLRANGSYKVSGAKTFSEAVKGMFKIGGAKYDYAGSGYESYLVGASSRLKAIEAENGSLGKYDTATVTDVGSTDKIEVNIEGIEISINGVKYTISKKPV

SEQ ID NO: 1857 - protein, 411 aa, Bifidobacterium scardovii
MGKHKNKNGPVTALIAMVVAVLMSCMPVAAMADMVGIDVSGWQDINVTCTAEYDFAVVKVSQGIGFENGSWRQQARCVTDRGKSLGLYHYAGGNNASSEADYFVSLASDYIGRAVLVLDWESYQNAQWGNSDWVREFVQRIHTLTGVWPMVYVQASALNQIPSDVRASCGLWVAQYASNAPTGYQSRPWNYAIYGEAMRQYTANGWISGYNGPLDLNYFRGDASQWQAYANPAGKAQTTTPPQVEKPPAQTVDLQALATATIRGDYGNGQQRRDALGANYDKVMAIVNQRLTTTPTTQTQHQATATGATRVTVRAGDTMSAIAARTGLWPLSKWNVPSGNLNLIYPGQVVTYNGDRSTAASGNATRSRTVTVRAGDTLSGIAARLGISYTQLSGYRSGNPNVIYPGEVLRY

SEQ ID NO: 1858 - protein, 38 aa, unidentified
  REGION 1..38: note = Peptoniphilus grossensis
MAREVIRGDWGNGQDRKNRLERAGYDYNAVQRRVNELL

SEQ ID NO: 1859 - protein, 400 aa, Bifidobacterium breve
MRILAVVVAVLLACTPAIAMADMVGIDVSGWQASNVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTVDLQALATATIRGDYGNGQQRRDALGANYDKVMAIVNQRLAGTATVAPQQAAQANTTRVTVRSGDTMSGIASRTGLWPLSRWSVPSGNINRIWPGQVVTYNGGGSVATGGNAPPATRTVTVRAGDTLSGIAARLGISYTQLTGYRSGNPNVIYPGEVLCY

SEQ ID NO: 1860 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTSGKSLETLVQETLAGKYGNGDARKAALGNQYEAVMAVINGKATTNQKTVDQLAQEVIQGKHGNGEARKQSLGSQYDAVQKRVSELLKKQPSEPSNSQEVKQVTETKTSQTEPTEKATASKEDGDLSFNGAILKKAVLEKILANCKKHDILPSYALTILHFEGLWGTSAVGKADNNWGGMTWTGQGSRPSGVTVTQGSARPSNEGGHYMHYASVDDFLTDWFYLLRAGGSYKVSGAKTFSEAVKGMFKIGGAVYDYAASGFDSYIVGASSRLKAIESENGTLSKYDTATVTDVGSKDHIDITIDGIEVIINGETYKLEKKPV

SEQ ID NO: 1861 - protein, 468 aa, Streptococcus suis
MTINLETSIRWMSDRVGLVKYSMDYRNGPNSFDCSSSVYYALMAGGAISAGWAVNTEYEHDWLIKNGYKLIAENQDWDAKRGDIFIWGRRGQSAGAGGHTGIFIDPDNIIHCNYARNGITVDNYNQTAAASGWMYCYVYRLANQTGTSSKSLETLVQETLAGKYGNGEQRKAALGNQYEAVMAVINGKATTNQKTVDQLAQEVIQGKHGNGEARKQSLGSQYDAVQKRVSELLKKQPSEPSNSQEVKQVTESKTSQTEPTEKATASKEDGDLSFNGAILKKAVLEKILANCKKHDILPSYAVTILHYEGLWGTSAVGKADNNWGGMTWTGKGERPSGVTVTQGSARPSNEGGHYMHYASVDDFLTDWFYLLRAEGSYKVSGAKTFSEAVKGMFKIGGAVYDYAASGFDSYIVGASSRLKAIEAENGSLAKYDTATVTDVGSTDKIEVNIEGIEISINGVTYTLSKKPV

SEQ ID NO: 1862 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKSDTSGNTPKTPSDTPKSGAVNSSTEPKIEETESTGQATEIKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 1863 - protein, 479 aa, Streptococcus suis
MGVNIETALRWMSDRKGRVTYSMDYRNGPNSFDCSSSVYYALMSAGAISAGWVVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGGQRKAALGNQYEAVMAVINGKATVPKKTIDQLAQEVIQGKHGNGEDRKKSLGPDYDAVQKRVTEILKGSTSGNTPKTPSDVPKSEAVNSSTETKTEETEATGKVTEPKIVKEAGDLSFNGAILKKSVLDVILAKCKEHDILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKVGGAVYDYAATGYDNYLVGMSSRLKAIEAENGSLTKYDTATVTDVGSTDKIEVNIEGIEISINGVTYTLSKKPV

SEQ ID NO: 1864 - protein, 357 aa, Streptococcus suis
EYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAAKKSIDELVQEVIAGKHGNGEERKKSLGPDYDAVQKRVTEILKGSTSGNTPKTPSDTPKSGAVNSSTEPKIEETEPTGQATESKEDGDLFFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAAT

SEQ ID NO: 1865 - protein, 390 aa, Bifidobacterium breve
MLLATAPAIAMADMVGIDVSGWQAANVTCTASYDFAVVKVSQGVGFENGSWRTQAKCVTDRGKSLGLYHYAGGNDASSEADFFVGRARDYIGKAVLVLDWESYQNAQWGNGDWVRRFVQRVHTLTGVWPMVYVQASALNQIPSDVRANCGLWVAQYASNAPTGYQSRPWNYSIYGEAMRQYTSNGWVSGYNGPLDLNYFRGDASQWQAYANPAGKAQTTTPPQVETPPTQTVDLQALATATIRGDYGNGQQRRDALGANYDKVMAIVNQRLNAGATTQTQQTTSNATRVTVRAGDTMSAIATRTGLWPLSKWSVPSGNLNLIYPGQVVTYNGGGSTATAGNAPPATRTVTVRSGDTLSGIAARLGISYTQLSGYRSGNPNVIYPGEVLRY

SEQ ID NO: 1866 - protein, 411 aa, Bifidobacterium breve
MGKFKNKSKPITAIIAAFVAMLLAATPAIAMADMVGIDVSGWQAANVTCTASYDFAVVKVSQGVGFENSSWRAQAKCVTDRGKSLGLYHYAGGNNAEAEADYFVGRARDYIGRAVLVLDWESYQNAQWGNSDWVRRFVQRFHTLTGVWPMVYVQASALGQIPGDVRANCGLWVAQYASNAPTGYQSRPWNYAVYGEAMRQYTSNGWISGYNGPLDLNYFRGDASQWQAYANPAGAAKPATPPQTEKPPTQTIDLQALATATIRGDYGNGQQRRDALGANYDKVMAIVNQRLAGTATVAPQQTTQANTTRVTVRSGDTMSGIASRTGLWPLSKWSVPSGNLNLIYPGQVVTYNGGGSVATGGNAPPATRTVTVRAGDTLSGIAARLGISYTQLTGYRSGNPNVIYPGEVLHY

SEQ ID NO: 1867 - protein, 411 aa, Bifidobacterium longum
MGKFKNKSKPITAIIAAFVAMLLAATPAIAMADIVGIDVSGWQAANVTCTASYDFAVVKVSQGVGFENGSWRAQAKCVTDRGKSLGLYHYAGGNNAASEADYFVAKARDYVGRAVLVLDWESYQNAQWGNSDWVRRFVQRVHTLTGVWPMVYVQASAIRQIPSDVRANCGLWVAQYASNAPTGYQSRPWNYAIYGEAMRQYTSNGWVNGYNGPLDLNYFRGDAGQWQAYANPAGAAKPATPPQTATPPTQTIDLQALATATIRGDYGNGQQRRDALGANYDKVMAIVNQRLAGTATVAPQQTTQANTTRVAVRSGDTMSGIASRTGLWPLSKWSVPSGNLNLIYPGQVVTYNGGGSVATGSNAPPATRTVTVRSGDTLSGIAARLGIGYTQLTGYRSGNPNVIYPGEVLHY

SEQ ID NO: 1868 - protein, 411 aa, Bifidobacterium adolescentis
MGKIKNKSKPLQALIAALFAVLLACTPAIAMADMVGIDVSGWQDANVTCTASYDFAVVKVSQGVGFENSSWRTQAKCVTDRGKSLGLYHYAGGNNAEAEADYFVGRARDYIGRAVLVLDWESYQNAQWGNSDWVRRFVQRVHTLTGVWPMVYVQASALGQIPGDVRANCGLWVAQYASNAPTGYQSRPWNYAIYGEAMRQYTSNGWVNGYNGPLDLNYFRGDASQWQAYANPAGAAKPVTPPQTEKPPTQTVDLQALATATIRGDYGNGQQRRDALGANYDRVMAIVNQRLAGTATVAPQQTTQSNTTRVAVRSGDTMSGIASRTGLWPLSRWSVPSGNLNLIYPGQVVTYNGGGSVATGGNAPPASRTVTVRSGDTLTGIAARLGISYTQLTGYRSGNPNVIYPGEVLHY

SEQ ID NO: 1869 - protein, 102 aa, Arcanobacterium hippocoleae
MLNGTAPAPAPAAFDVEQAARAVIAGKYGNGEQRKAVLGANYAAVQARVNQILNGSAPAAFDIEQAARAVIAGKYGNGQARKSALGANYAAVQARVNQILGA

SEQ ID NO: 1870 - protein, 408 aa, Bifidobacterium breve
MGRFKNKSKPLQALIAALFAVLLACTPAIAMADMVGIDVSGWQASNVTCTAQYDFAVVKVSQGVGFENSSWRTQARCVTDRGKSLGLYHYAGGNNAASEADYFVGRARDYIGRAVLVLDWESYQNAQWGNSDWVRRFVQRVHTLTGVWPMVYVQASALNQIPSDVRANCGLWVAQYASNAPTGYQSRPWNYSIYGEAMRQYTSNGWVNGYNGPLDLNYFRGDAGQWRAYANPAGAAKPATPPQTEKPPTQTVDLQALATATIRGDYGNGQQRRDALGANYDKVMAIVNQRLNGTTTVVQQQTTAATRVTVRAGDTMSGIASRTGLWPLSKWSVPSGNLNLIYPGQVVTYNGGGSVATGSNAPPSRTVTVRAGDTLSGIAARLGIGYTQLTGYRSGNPNVIYPGEVLHY

SEQ ID NO: 1871 - protein, 481 aa, unidentified
  REGION 1..481: note = Streptococcus sp. ZY19097
MAVNIEAAIAWMSSRVGKVTYSMDYRNGPGSYDCSSSVYYALMSAGAISAGWAVNTEYEHDWLIKNGYKLIAENQDWDAKRGDIFIWGKRGQSAGAGGHTGIFIDADNIIHCNYANNSITINNYNQTAAASGWMYCYVYRLANQSTPSTSGKTLDTLVKETLAGKYGNGDQRKAALGNQYEAVMAVINGKATAPKKTIDQLAQEVIQGKHGNGEDRKKSLGPDYDAVQKRVTEILKGGTSGNTPKTSSDAPKSEVVNSSTEPKTEETGATGKVTDTKITKEDGDLSFNGAILKKSVLDVILAKCKEHNILPSYAITVLHFEGLWGTSAVGEADNNWGGMTWTGKGERPSGVTVTQGTARPASEGGNYMHYATVDDFLTDWFYLLRSGGSYKVSGAKTFSEAIKGMFKVGGAVYDYAATGYDNYLVGMSSRLKAIEAENGSLTKYDTATVTDVGSTDKIEVNIEGIEISINGVTYTLSKKPV

SEQ ID NO: 1872 - protein, 297 aa, unidentified
  REGION 1..297: note = Clostridiales bacterium
MFGIDVSYHKGNIDWNKVKPNINFAILRLGWVGNKKNHSLDSKFEQYYRQCKKLNIPIGVYVYNYCNSEENARDGAKWAIDKLKNKTLELPVYFDMEDESIQNLGRDKLTSICIAFNTEIEKTGLWAGVYANLYWYNNYLNKEEIKKRYTTWIAHYTDGTDKYKGEYDMWQNSSTGKINGVSSDVDTDYLYRDLISQIGNIKPTNPNDEILRLANEVISGKYGNGEERKKALGDKYAVVQDKVNELMAERNEITYVIKKGDTLSGIAKKFHTTVKELARKNNIKDINKIYAGDVLKI

SEQ ID NO: 1873 - protein, 353 aa, unidentified
  REGION 1..353: note = Caudoviricetes sp.
MAMQGIDISGWQDDLDLAQVPCDFAIIKATQGVGYVSDACDPHVQQAIALGKPFGFYHYVNGSGATAEADFFVDNCANYFGVGLPCIDWESMQNAAWGDADYLRELVQRVIDRTGVKPLIYASKSAFPWDVAKALDCGAWVAQYANDNATGYQDSPWNEGAYDCAIRQYSSHGRLDGYSGNLDLDKAYMDADGWARYVGASGAPAPAPAKKTDEQIADEVIAGAWGNGEDRRNRLSSAGYDPDAVQAIVNARLQPSRKSDDEVADEVIRGEWGNGSDRRDRLAQAGYDPDAIQSVVNSKLGASAPAHRTYTVKSGDTLSGIAAAYGTSWQHLASINGIANPNLIYPGQVLTVG

SEQ ID NO: 1874 - protein, 359 aa, unidentified
  REGION 1..359: note = Caudoviricetes sp.
MTLNGIDISNWQRGIDLSKVPCNFVIAKATEGIGYVDKSCDGFIQQAIKLGKPFGFYHFARPTANNDAIREADYFYNNCKGYFGKGVPILDWEAENKHNVAYAKKWLDRVYQLSGVKPVIYMSESVVNSYDWSSVANADYGLWVAKYRDNNPDYNYNMANAGSRPHVKWWKFYCMWQWTSSGRLNGYNGNLDCNVFYGDQSTWDAYVGKSTSTVKPKPASKTTDQLADEVIAGQWGNGEDRKKRLTDAGYNYNAVQNAVNAKLAKKSNDEIAQEVIAGKWGNGEDRKNRLTQAGYDYNSIQNIVNQKLGASQAVYYTVRSGDTLSGIASKYGTTYQHLAQINGIANPNKIYAGQKLRVK

SEQ ID NO: 1875 - protein, 276 aa, unidentified
  REGION 1..276: note = Caudoviricetes sp.
MEFPVINSNRQWVNNFINGIAPLVCEEYLKRKSAGEKVVTPATVIAQACLESGYNLNASTLFGIKGNGVTSSTTEFVNGNYVNITASFNYYPNIAAAVTGYYDLMQWNNYDDVTSAATVQDEVVGLTNDIGYAYATDPNYYDKIMSIVETNNLYVFNDYVHSYNYNTPQDENEFNSNIAATKTDEELADEVYLGLWGIMPERKERLEAAGRDYEAIRTIVNSKYYGIENKKTVDELADEIWRGEWGDNPERRERLEADGYDYEAVQRRVMEKYYNG

SEQ ID NO: 1876 - protein, 384 aa, unidentified
  REGION 1..384: note = Planctomycetia bacterium
MGHQISLRRSRSRQILCGIACIFLCAIPEWPGIDRPGKFCRAETLEDAWNVAFTQSRKLQSQESRIEAAQAEGNAARAARMPRISNTSAYIGLSERPLFTTDLNLGESLPPTMAGLFPSKIESPIADRSFAISLTTVSVPLYTGGKITGLIDAADAMTAAAQSEHQGEVHDLKLEVAETYLAVLRTQRLVEVAEQAERSLAAHMKDVDNLLAAGFVTRNASLAARVAHADSEQKVLQAQVGFQTASAAYNRLLWRPLDTPVQLEEMDIPPFTGELTTLTEQAVANRSELNLLAAQSRALQAQARVHRADRLPDVLAAAGYNYSGIQEKVNELLSGSAKPNMKSNDEIAREVIRGEWGNGQDRRNRLSAAGYNADAVQAVVNKML

SEQ ID NO: 1877 - protein, 354 aa, unidentified
  REGION 1..354: note = Merdibacter sp.
MPVLNGIDISNYQRGLDVRTIKADFVIVKASEGIGYEDPSCHTFAKAALSSKKKLGLYHFARPGKENPAVKEAEWFLRIFKPYIGKAIPVLDWEAEEIGNVKWAKQWLDEVFKKTRVRPWIYMSESVANSHNWSQVAKHYRLWMALYRSNAPAYNYDMRNAGTLVSTRYWKSTACWQWTSHGRLAGWNGNLDFDRFYGNRTDWDEETRRQEDRRKKSNEQIAAEVIAGKWGQGAERDQRLKKAGYDPKVIMALVDEKTRKKSTDEIAEEVIKGKWGNGEERIRRLEAAGYDAKAVQKRVNERLQEMSKEYYTVRKGDTLEKIARRFATSVQRLAEMNHLPDPNYIVVGQRLRVR

SEQ ID NO: 1878 - protein, 287 aa, unidentified
  REGION 1..287: note = Bacilli bacterium
MAYIYNVVKSPIQGKTGTLSRSSGYEYRDFWYTNASGQKVHVVGWHRALDITTLGTVVAFARGKVVSIQKGITGQTTNPSGGNSVTLLHANGYKTLYCHLDNGSNNHLNLGDIVEEGAKLGTDVIKTTGNSTGLHLHFGIYNGSEYVDPTPYLQGSKQVVGYGGSPTPAVDPFPGVSDEELARRVWTGEFGNGDTRRQRLGSRYSAVQALVNKGVGKPSTPTPAPQPQPSKPDLLTMVRRTIRGDFGNYPARKANIEKLGWDYATVQHQVNENVKRNNWNWDKIRLY

SEQ ID NO: 1879 - protein, 402 aa, unidentified
  REGION 1..402: note = Bacteriophage sp.
MNKANHHKNLIRRIIISVLAVIFALTGAGVANAANLLDVSSWQTGINVTTTGADIVVAKATEGTYYVNRDCDRVIQQALSSGKGAGVYHFANTADSPIAEADYFVSQTRGYVGKGIVPILDWEPRAPGNVQWAQTWLNRVESRWGTKPIIYMNQSTENSYNWAPVVQQNYGLWIAAYTLGYQPIYGFNPPAAQPRMYHWPFAVAWQYTSSGRVNGWNGNVDLSVVYGSLDTWRAYAGGGGTTAAATTPKTPAAPSISGSDSELADRVIRGEFGTIPQRQALLGSRYAAVQAIVNQRLNGVANSGANFIGACAVVARGDSLSGIASRLGTNWQNLTGYRSGNPNRIYPGERVCTKTGNAPVSNGHRVRAGESLWAIYGTGWQAAAVRNGIQAPYTIYPGQTLR

SEQ ID NO: 1880 - protein, 517 aa, unidentified
  REGION 1..517: note = Arcanobacterium sp. S3PF19
MSKKMLKGTGTTLAVAALVGAVAPTAATPANNIPEQNADPHLRGNTVLDHEALSQTDGKQKIKTGYKVQSGDDLSAIAQKFAVTEKDLIAANRLEAGAALRPGKWLQIPAADADKDSQTKSAPESNTPAAPAPAPVAAAVHTAGNTPAAPAAPLHSAAPAARRIVTPAHPAASAERSADRKAFAGYTVFAAFDAKTSLDRNRSVSAAEAKPAVAKKRTRRALSEAPQTDPQPVLVPKISVSASPKQNPSPAPTPAPVAAAVHTAGNTPAAPAAPKTAVQSAAPAEVRKADTPEDTDRLAREVMAGKYGSGETRRALLGSRYAAVQQRVNQISGSRAQAKPAQTQAAAPKTGKTPKAQLVKNNFPGYTYPQATVNAANENKHALVASKLPSKAEVQRMVAGTAAQMGVNPKLALAHAFVESGFDAAAVSPANAVGTMQVIPGSGKWAGSLVGRKLNLLNPQDNIVAGVAIIRYLQKHADSLEQGIAGYYQGLGGVKKNGMRPDTVKYVAKVKNAMSRF

SEQ ID NO: 1881 - protein, 425 aa, unidentified
  REGION 1..425: note = Bifidobacterium moukalabense
MINNKGKPKHKRPAIRDWPRTIVALAFALSALLAPCATADTGIDTASYQGCWDGARAKAAGVNFAFVKLNEGTGYVNPYATCQISTMRANGIREGAYDFASPQTSTPEAEADRFVSEARTRGMIGRAIPVLDWEPSAPGGYWARQTWWALRWVNRVKATWGVTPMIYMSASTISSADWSQVAATDAGLWVAGYPRGYAGERLRNPGAVPYDVGPWPFAAAWQYSSSGSVGGVSGAVDVNWFYGDALTWQKYAGTAADSVPSNTTTTPKNNKTNGMPVADTQTLATLVIRGDYGNDPQRRRLLGSRYAEVMAVVNRRLSGSSGSVAGNNGGAYCVVVSSGDTVSAIAARTGRTPASAWNVPSGNINRIWPGQRICHGGSTTAPAGGTHVVRSGESLWSIYGTGWRAAAQRNGLRYPYTIYPGQYLR

SEQ ID NO: 1882 - protein, 355 aa, Collinsella aerofaciens
MTVQGIDISNYQRGIDLDKVPFDFMICKATEGTGIVHDTCDGFVQKAKALGKKWGFYHFLNGEDPVKQAEFFVSQTKNYFGNGVPALDYEMYGMVHGAAGAKKFLDRVHELTGIRCAVYMSRSVCTEDDWSAVAKDHPLWVAQYANTERTAYQATPWLPSGGFGAWNECALHQYSSNGRLDGYAGPLDLDIAHLDADGWDRVANPKGLPVPDAKPSGTVPQPQETALELAARVMDGTYGNGDAREKALGDRYDEVQELVNYVLKTSATELADAVIRGQLGSGELRKRVLGGRYAEVQGVVNDRLGASSKKTYTVKSGDTLSGIAAEYGTDYQTLAKANGLANPNVIYPGQVLVVG

SEQ ID NO: 1883 - protein, 138 aa, Bifidobacterium catenulatum
MATATIRGDYGNGEARRAALGANYGPVMRIVNQRLNGSAAYAPAASTRSVNVTVRNGDTMSGIAKRTGLWPLSAWSVPSGNINLIYPGNIVTYRGTATSTSSGSIATGGRVHIVKSGETLSGIFGANGWQRVAQLNNL

SEQ ID NO: 1884 - protein, 412 aa, unidentified
  REGION 1..412: note = Bifidobacterium pseudocatenulatum CAG:263
MGILNNKGKPKHKRLRRHMGRPLTALAAVLCVAVAPVASANMNVIDVSGWQSADVTRVVDADAAIVKITEGSGYVNPSWRSQTDWTRQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTHAEVKHDPVRPQVTATPDYNDMATKVIRGVYGNGSERRQALGGAYDTVMAIVNQRLGGSGGAPAAVNCGSVCVTVRYGDTLSTIAARNGGSWNQWTGYRSGNPNVIYAGETVCRRTGTGTVATGGRYVVRSGDTLGGIAAYYGVNMYSIHGYRSGNPALIYPGETLYW

SEQ ID NO: 1885 - protein, 397 aa, unidentified
  REGION 1..397: note = Caudoviricetes sp.
MRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTHAEVRHDPVRPQVTATPDYNDMATKVIRGVYGNGNERRQALGGAYGTVMAIVNQRLGGSSGASAAVNCGSVCVTVRSGDTLSTIAARNGGSWNQYTGYRSGNPNVIYAGETVCRRTGVASTATVATGGRYVVRSGDTLGGIAAYYGVNMYSIHGYRSGNPALIYPGETLYW

SEQ ID NO: 1886 - protein, 368 aa, unidentified
  REGION 1..368: note = Caudoviricetes sp.
MTMNGIDISSWQSGIDVAKVPCDFVIAKATQGTNYVNPDCDRVVQQAIKLGKCWGTYHYVDGSGAVAEADYYVNNVRGYVGKGVLCIDWESAQNGAWGNYGYLDALVARVIERTGVKPLIYAQASVYAQAAEVAKKYDCGLWIAQYADMNATGYQGTPWNEGAYSCAIRQYSSAGRLPGWGGNLDLDKFYGDAAAWQKYAGASGTPAPAPAPKPVDPLAGKSDAQLADEVLAGKYGDGDARKAALGSRYEAVQAVVNQKLGTSSTSATQTYTVKSGDTLSAIAAKYGTTWQALQQINGIADANRIYPGQVLKVAGSAAAPAAKTYTVKSGDTLSGIAAKYGTTWQHLQQINGIADANKIYPGQVLKVG

SEQ ID NO: 1887 - protein, 301 aa, Aeriscardovia sp.
MMIRGIDISNWQNGIELSYLDIDFCIFKATEGIGYTDPTANDHHDQCIDNGLLWGFYHFARENEPEDEAEWFYNECKGYIGNGIPVLDYETQNHNDVEWCERFVWHFHELSGIWCMLYLAAYYNPGVANFEDSWLSDKCALWLAGYPFTITDFSDAGVPCSAYYNPSPWDYASIWQFTSELIIPGYHAKLDGNIAYMDSTAWMKIATSDGEIEPIEPVQPTKSTDDLVLEVLLGEYGNGEDRKRLLGDRYDEVQSRLNELYGIAEEVIEGKWGNGWNRMNALNGAGYPYDIVQRIVNALLE

SEQ ID NO: 1888 - protein, 414 aa, unidentified
  REGION 1..414: note = Bifidobacterium tibiigranuli
MIPSHARHKLPPRRTLMPAAALVAVLALAFPADAMADSGVDVSNWQGCINAPRAQSAKSAGTSFGIVKATEGTGFTDNTADCTMTGLVQAGIRRAVYHFARPEYGNSPEAEADYFISQTRGYVGQGVLPVLDWEPGGGQKGNVAWAKRWLDRVSAAWGVKPLIYMSASTISMGDWTPVAQADYGLWVAGYPNGYAGDRLRDPGTPPYSLGPWPFAAAWQYSSSGSVPGIGDRIDVDWFYGDAVTWSKYANAPLPAAPAVTPGRPVPAPVQSTPKGDSSTIASAVIRGEYGNDPQRHALLGSRYDEVMSIVNQRLSGSSASGTGYYTVQPGDYLSKIWPASWRSIAALNGLRPPYVIYPGQRLSTSGAASGRSAVVRPGDTLTGIAARLGVSASSLHGYRSGNPNLIYPGETLAY

SEQ ID NO: 1889 - protein, 419 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTKTEVRHDPVKPQVTTTPDYNDMATKVIRGVYGNGNDRRQALGGAYDRVMAIVNQRLGGGSTVSASANTNCGSVCVTVKSGDTLSTIAARNGGSWNQYTGYRSGNPNIIYAGETVCRRGTGVARQPVSNTYSTHRYTVRSGDTLSRIAGYYRVNMYSIHGYRSGNPALIYPGETLYW

SEQ ID NO: 1890 - protein, 419 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYSSMNATGWQSTPWNAGSKGEGMVQYASTGYLNGVGPLDLNLFFGERDAWQKIANGDRGKTKTEVRHDPVKPQVTTTPDYNDMATKVIRGVYGNGNDRRQALGGAYDRVMAIVNQRLGGGSTVSASANTNCGSVCVTVKSGDTLSTIAARNGGSWNQYTGYRSGNPNIIYAGETVCRRGTGVARQPVSNTYSTHRYTVRSGDTLSRIAGYYRVNMYSIHGYRSGNPALIYPGETLYW

SEQ ID NO: 1891 - protein, 471 aa, Streptococcus suis
MAANMQQAIAWMEARRGKVTYSMDYRNGPNSYDCSSAVYYALMSAGAISAGWAVNTEYMHDWLIKNGFKLIAENSVFAAQRGDIFIWGRRGESSGAGGHTGIFVDSNNIIHCNYARNGITVDNYLATARASGNMYYYIYRPSGQSAVSTSTAGKSIDQLVQETLAGKYGNGDARKAALGNQYQAVMDRINGKTSAPQKTDEELAREVIAGKHGNGEDRKRSLGSRYPAVQKKVDELLKKPAASQPTPQPAPKVETPKQESAPVQFREDGDLSFNGAILKSEVLKKILAKCKEHDILPSYALTILHYEGLWGTSAVGKADNNWGGMTMTSNDLQITRPSGVVVTRGLARPSNEGGYYMHYATVDDFLTDWFWLLRKDGSYKVSGARTFSDSIKGMFKIGGAKYDYAAAGYESYLVGASSRLKAIESENGSLTKFDAVSNNVHSVDPDKISVDIDGIEVTINGVVYKLEKKPV

SEQ ID NO: 1892 - protein, 364 aa, unidentified
  REGION 1..364: note = Arthrobacter phage Giantsbane
MVLPINGINEQFNAAFFTPGPTQKDGIVIHWWGLPQGQTIQSVRDTFGGGGRQASAHYGCSDGVVDCYVSPDDVAWANGHWGANLSKISIECDPRQSDGDYYAAAWTVAYIRSIYGDLPLSRHDNYFATQCCGTYDIARIDRLARTINVNTASKPTPAKPAPVKPAVPAVKGKTIAQLADEVLKGAYGTGDQRRLALGANFQAVQDEVNRRLSGAANPKPKPNISALADQVLAGKFGTGDQRITALGVNYQAVQDEVNRRINAKPTAKPAPKPVVKPAPKPVVNISDLVRRTLNGEFGNGDERKRRLGANYQAVQNAINAGAKPNINDLVARTLKGEFGNGDERIRRLGSNYNAVQAEINRRYS

SEQ ID NO: 1893 - protein, 347 aa, unidentified
  REGION 1..347: note = Bacteriophage sp.
MAGILPTIIDISEWQGGIAWATVKGNIHFAIVRVQDGTLIDERLRQNISGCEQQGIPYYLYGFYRNGGAVEAARMVSRAKVAGATKQRGYVLDVEVSGQSKANIKSAMATLNASGLDNGIYIANHLYSEYGGEDYGEKWRWIPTYGVNDGKAHTAPKHYCDLWQFTSAGKVPGISGNVDCNALNGKRTLASFTTEAVSGKPTGGDVADGSTLDLTRSAAELVGDVLAGDAGNGSVRKAKLGSRYDEIQALVNHVLTASASTLAQEVIDGEWGNGETRKRAMGARYDEVQEKVNAKLGASSAKTYTVKSGDTLSEIGAELGVDWKDIAAKNGISAPYTIYPGQQLMVG

SEQ ID NO: 1894 - protein, 347 aa, unidentified
  REGION 1..347: note = Bacteriophage sp.
MAGILPTIIDISEWQGGIAWATVKGNIHFAIVRVQDGTLIDERLRQNISGCEQQGIPYYLYGFYRNGGAVEAARMVSRAKVAGATKQRGYVLDVEVSGQSKANIKSAMATLNASGLDNGIYIANHLYSEYGGEDYGEKWRWIPTYGVNDGKAHTAPKHYCDLWQFTSAGKVPGISGNVDCNALNGKRTLASFTTEAVSGKPTGGDVADGSTLDLTRSAAELVGDVLAGDAGNGSVRKAKLGSRYDEIQALVNHVLTASASTLAQEVIDGEWGNGETRKRAMGARYDEVQEKVNAKLGASSAKTYTVKSGDTLSEIGAYLGVDWKDIAAKNGISAPYTIYPGQQLMVG

SEQ ID NO: 1895 - protein, 360 aa, unidentified
  REGION 1..360: note = Shouchella patagoniensis
MAKIAICAGHGGSNSTPGKRTPAGEYEWNFNDKVVRAAVAVFEASGHKVRRFDDASGKTDVSLQTRTNAANAWGADIYISIHHNAMTGVWYNHAMGIETFTQNGSHPESEKLAAAVHPLYLAAMGLRDRGIKKANLHINRETRMPSILTEGGFMDSRVDIVAMRDNSKLKAQGEAIAAGAIAYLGGKVTVPNESQVGGVIVDNKPAPSPSAGGKTDAQLADEVIAGKHGSGDARKKSLGNRYDAVQALVNQKLSGSKPAPAKPKKSISQMATEVLNNQHGNGHDNRRRSLGISQAEYEKVRAEVNRRAGGGSKSPAKSVDQMAREVIAGKHGNGHDNRRRSLGISQAQYNQVRARVNQLA

SEQ ID NO: 1896 - protein, 358 aa, unidentified
  REGION 1..358: note = Lacticaseibacillus absianus
MTNFFVADVSSHDTIDAAALPQIGAVIIKATQGTTYVNPKCNGQYAAAKAAGKKLGLYHYASGSDPVAEANYFISNIKNYVGEALLAIDWEGYQNAAYGKNANWVKQFVTRVHELTGQWCLLYTGADGARECANVKDLCGLWFAGYPYYPGTKKMYPTFTVPTKFPYSTAPWPTYTLWQFTSSDGTKDMSISNMPLESWEKFIGKAIAPVPSPVPTKTVAQLAAEVISGKYGSGNARKAALGSQYAAVQAEVNRQLGATSKPAAPKPAPAPTGKKAGVWYAQNGTFTLGANQQIWLRSAPLTGQKIALMHSGQEIKYNAYGYFNGYVVIRQKRATGYGYIATGTASGTKRTSYWGNFK

SEQ ID NO: 1897 - protein, 358 aa, unidentified
  REGION 1..358: note = Lacticaseibacillus absianus
MTNFFVADVSSHDTIDAAALPQIGAVIIKATQGTTYVNPKCNGQYAAAKAAGKKLGLYHYASGGDPVAEANYFISNIKNYVGEALLAIDWEGYQNAAYGKNANWVKQFVTRVHELTGQWCLLYTGADGARECANVKDLCGLWFAGYPYYPGTKKMYPTFTVPTKFPYSTAPWPTYTLWQFTSSDGTKDMSISNMPLESWEKFIGKAIAPVPSPVPTKTVAQLAAEVISGKYGSGNARKAALGSQYAAVQAEVNRQLGATSKPAASKPAPAPTGKKAGVWYAQNGTFTLGANQQIWLRSAPLTGQKIALMHSGHEIKYNAYGYFNGYVVIRQKRATGYGYIATGTASGTKRTSYWGNFK

SEQ ID NO: 1898 - protein, 413 aa, Bifidobacterium pseudocatenulatum
MGILNNKGKPKHKRLRRHIGKPLTALAAVLCVAVAPVASANMNVIDVSGWQSADVTRVVDADAAIVKITEGSGYTNPSWRSQTDWARQTGKACGGYHYADGGNVTAEVNHYLNQFNGYVGQCVLALDWESNGNAAWGNGDWVRQWVNQVYSRTKVWPIVYVQDSAVYQIPSDVRAHCMLWKAQYASMNATGWQSTPWNAGSKGEGMVQYASTGYLNGVGPLDLNLFFGERDAWQKIANGDRGKTNAEVRHDPVRPQVTATPDYNDMATKVIRGVYGNGNERRQALGGAYDTVMAIVDQRLGGSAGTVSNTSNCGSVCVTVRYGDTLSTIAASNGGSWNQYTGYRSGNPNVIYAGEIVCRRTGTGTVATGGRYVVRSGDTLGGIAAYYGVNMYSIHGYRSGNPALIYPGETLYW

SEQ ID NO: 1899 - protein, 419 aa, Bifidobacterium adolescentis
MKIFGKKSPKHKKIPRNMRLPFAGLVVALCMIIAPIASANMNVIDVSGWQSADVTRVVDADAAVVKVTEGGGYVNPSWRSQIDWARQTGKACGGYHYADGGNVTAEVNHYLNQFNGYVGQCVLALDWESYGNHAWGNGDWVRQWVNQVYSRTKVWPIVYVQDSAVYQIPSDVRSHCMLWKAQYASMNATGWQSTPWNAGSKGEGMVQYASTGYLNGVGPLDLNLFFGERDAWQKIANGDRGKTKTEVRHDPVKPQVTTTPDYNDMATKVIRGVYGNGNDRRQALGGAYDRVMAIVNQRLGGGSTVSASANTNCGSVCVTVKSGDTLSTIAARNGGSWNQYTGYRSGNPNIIYAGETVCRRGTGVARQPVSNTYSTHRYTVRSGDTLGRIAGYYRVNMYSIHGYRSGNPALIYPGETLYW

SEQ ID NO: 1900 - protein, 346 aa, unidentified
  REGION 1..346: note = Enorma sp.
MAGILPTIIDISEWQGGIAWVTVKSNVHFAIVRVQDGTLIDERLRQNISGCEQQGIPYYLYGFYRNGGAVEAARMVSRAKAAGATKQRGYVLDVEVSGQSKANIKSAMATLNASGLDNGIYIANHLYSEYGSKDYGEKWRWIPTYGVNDGKAHTAPKHYCDLWQFTSAGKVPGISGNVDCNALNGKRTLASFTTDEVSGKPTGGDVADGSTLDLTRSAAELVGDVLAGDAGNGSVRKAKLGSRYDEIQALVNHVLTASASTLAQEVIDGEWGNGETRKRAMGARYDEVQEKVNAKLGASSAKTYTVKSGDILSEIGANLGVNWKDIAAKNGIAAPYTIYPGQKLVI

SEQ ID NO: 1901 - protein, 157 aa, unidentified
  REGION 1..157: note = Bifidobacterium tibiigranuli
MSASTISAGDWTPVARADYGLWVACYPNGYAGDRLRDPGTPPYPLGPWSFAAAWQYSSSGSVPSIGERIDVDWFYGDVVAWSKYANAPLSAAPAPEPGNPAPAPVQSTPQGRAGQIASAVIRGEYGNDPQRRALLGGRYDEVMGIVNQQLSGGAASG

SEQ ID NO: 1902 - protein, 417 aa, unidentified
  REGION 1..417: note = Bifidobacterium tibiigranuli
MRIASHAKHKHTPRRTIRPAAAIVAVLALALPVDAMADSGVDVSNWQGCVNAPRAQSAKSAGTSFGIVKATEGTGFTDNTADCTMTGLAQAGIRRAVYHFARPEYGNSPEVEADYFISQTRGYVGQGVLPILDWEPGGGQKGNVAWAKRWLDRVSAAWGVKPLIYMSASTISMGDWTPVANADYGLWVAGYPNGYAGDRLRNPGQPPYSLGPWPFAAAWQYSSSGSVPGIGDRIDVDWFYGDAVTWAKYANAPLPAAPAVTPSRPVPAPVQSTPKGDAGTIASAVIRGEYGNDPQRHALLGSRYDEVMAIVNQRLAGGTTASGPGAYIVQPGDYLSRIWPSSWREIAAFNGLSSPYVIYPGQRLSTNGTASSGRSVVVRSGDTLSSIAARLGISASSLHGYRSGNPNLIYPGESLAY

SEQ ID NO: 1903 - protein, 415 aa, Bifidobacterium subtile
MIPSHARHKRPPRRTLMPAAAIIAILALAFPADAMADSGVDVSNWQGCINAPRAQSAKSAGTGFAIVKATEGTGFTDNTADCTMTGLAQAGIRRAVYHFARPEYGNSPETEADYFISQTRGYVGQGVLPILDWEPGGGQKGNVAWAKRWLDRVAAAWGTKPLIYMSASTISAGDWTPVARADYGLWVAGYPNGYAGDRLRDPGTPPYPLGPWPFAAAWQYSSSGSVPGIGERIDVDWFYGDAVTWSKYANAPLPAAPAVTPGRPVPAPVQSTPKGDASQIASAVIRGEYGNDPQRRALLGSRYDEVMAIVNQRFSGSSASGTGYYTVQPGDYLSKIWPASWRSIAALNGLRPPYVIYPGQRLATGGAASSGRSVVVRSGDTLSSIAARLGISASSLHGYRSGNPNLIYPGEVLAY

SEQ ID NO: 1904 - protein, 420 aa, unidentified
  REGION 1..420: note = Caudoviricetes sp.
MNPRRQWRKLLTALAVAASMAVAPAAMADTGIDTASYQGCWDGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVNPWPFAAAWQYSSSGAVGGIGGAVDVNWFYGDAVTWAKYAGAPASSVTSNATTPPENNKTNGAPVADANTLASAVIRGEYGNDPQRRQLLGSRYTEVMAIVNRRLAGSSGSVSGNNGGAYCVVVSSGDTMSAIASRTGRTPASAWSVPSGNINRIWPGQQVCYGGSTASSVGAHVVGTSHVVTAGESLWAIYGPSGWQAAAQRNGLSYPYVIHPGQVLR

SEQ ID NO: 1905 - protein, 492 aa, unidentified
  REGION 1..492: note = Caudoviricetes sp.
IMAEQLRGGVCVNGLPVAGIYHAGLGSTASLASIPSFFQQTKATQTGGFFIAPNRGGKERNLNILNKGKPKHKHMNPRRQWRKLLTALAVAISMAVAPAAMADTGIDTASYQGCWDGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVNPWPFAAAWQYSSSGAVGGIGGAVDVNWFYGDAVTWAKYAGAPASSVTSNATTPPENNKTNGAPVADANTLASAVIRGEYGNDPQRRQLLGSRYTEVMAIVNRRLSGSGVTTPSGNTGYCVVVSSGDTMGAIASRTGRTPASAWSVPSGNINRIWPGQRVCYGGSTASNVGARTVGTSHVVTAGESLWKIYGSGWPAAAQRNGLRAPYTIYPGQVLH

SEQ ID NO: 1906 - protein, 460 aa, unidentified
  REGION 1..460: note = Caudoviricetes sp.
MCASRSSKPTTAAVSHPTTGITDRQERKRMTTANKGTPKHAKPRRRYRQPMVALLVAACLAIAPCAMADTGIDTASYQGCWDGAQAKSSGVNFAFVKLNQGTGYVNPYATCQVNAARANGIREGAYDFASPQTSSPEAEADKFVAEARARGMVGRAIPVLDWEPSAPGGYWGKQTWWALRWVNRVKSTWGVNPMIYMSAAMIPTGDWSAVVATNAGLWVAGYPRGYAGDRLRNPGAVPYSVSPWPFAAAWQYSSSGAVGGISGAVDVNWFYGDAVTWAKYAGAPASSVTPNATTPPPNNKTNGAPVADANTLASAVIRGEYGNDPQRRQLLGSRYTEVMAIVNRRLAGSSGSVSGNNGGAYCVVVSSGDTMSAIASRTGRTPASAWSVPSGNINRIWPGQQVCYGGSTASSVGAHVVGTSHVVTAGESLWTIYGATGWQAAAQRNGLSYPYIIHPGQVLR

SEQ ID NO: 1907 - protein, 429 aa, unidentified
  REGION 1..429: note = Caudoviricetes sp.
MTTANKGTPKHAKPRRRYRQPTVALLIAACLAIAPCAMADTGIDTASYQGCWNGAQAKSSGVNFAFIKLNQGTGYVNPYATCQVNAGRANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVSPWPFAAAWQYSSSGAVGGVSGAVDVNWFYGDAVTWAKYAGAPASSVTSNATTPPKNNKTNGAPVADANTLASAVIRGEYGNDPQRRQLLGSRYTEVMAIVNRRLSGSGVTTPSGNTGYCVVVSSGDTMGAIASRTGRTPASAWSVPSGNINRIWPGQRVCYGGSTASNVGARTVGASHVVTAGESLWKIYGSGWPAAAQRNGLRAPYTIYPGQVLH

SEQ ID NO: 1908 - protein, 373 aa, unidentified
  REGION 1..373: note = Caudoviricetes sp.
MSLKEDIRFLRGIDISNWQARIDLTAVPADFVIAKATQGTGYVSPDCARQVEQARQLGKRFGVYHYVSGGNAVAEANFFVDNCANWVGKGLFCIDWEANENSAWGDEGYLEQVVTQVRARTGIPPIIYVQASRYAQVAQVANRQNCGLWIAQYASSTPTGYQDVPWNEGAYDCVMRQYTDAGYLPGYSGSLDLNKFYGDGAVYDKYVTGDGNGSTAAPSQPADPLAGRSDDDLANAAIHGEFGDGDDRKQRLGARYEAVQALVNQKLATPASSDWTYTVQPGDSVSGIAAKLGVSQSQITGFHSGNPNLIYPGEVLSISGGSSQPQAEYYTVQSGDTLSAIAAQYGTSWQHLSDLNGLADPNLIYAGQCLRVK

SEQ ID NO: 1909 - protein, 366 aa, unidentified
  REGION 1..366: note = Caudoviricetes sp.
MSLNGIDISNWQAGINLAAVPADFVIAKATQGTGYVSLDCARQVEQARQSGKRFGVYHYVSGGNAIAEANYFVDNCANWVSKGLFCIDWESDENSAWGNEGYLEQVVAQVRARTGIPPIIYTGASRYTQVAPVANRQNCGLWIAQYANNVPTGYQDTPWNENAYACVIRQYSSVGRLPGYDGDLDLDKFYGDGATYDKYVTGGGNTSNVPPSQPADPLAGRSDDDLANAVIHGEFGDGDARKQKLSGRYDAVQALVNQKLAAPVSSGRTYTVQPNDTLSTIAAKLGVDQSQIAGFHSGNPDLIYPGEVLNISGGSPQPIAEYYTVQMDDNLSTIAAQYGTSWQHICDLNGLSNPDLIYPGQVLRVK

SEQ ID NO: 1910 - protein, 281 aa, unidentified
  REGION 1..281: note = Bifidobacteriaceae bacterium MCC01989
MQESACLRHQFVGVVNVHERTGVWPLVYVSAAFIPQIPADVRANCGLWVAQYANNNPTGWQSRPWNYGKYGEAMRQYTSNGRINGYNGPLDLNYFRGTREQWDKYANPNKASKPTPAPAPRPAPGVDYEALATATIRGDYDNGEARRAALGANYGPVMRIVNQRLNESAYAPAASTRSVSVTVRSGDTMSGIATRTGLWPLSAWSVPSGNINLIYPGNIVTYRGAATVASSGSVATGGRVHVVKSGETLSGIFGASGWQRVAQLNNLANPNLIYPGQRLRY

SEQ ID NO: 1911 - protein, 431 aa, Bifidobacterium adolescentis
MATANKGTPKHAKPRRRYRRPIAALLIAACLAIAPCAMADTGIDTASYQGCWDGAQAKSSGVNFAFIKLNQGTGYVNPYATCQVNAARANGIREGAYDFASPQTSSPEAEADKFVAEARVRGMVGRAIPVLDWEPSAPGGYWGKQTWWALRWVNRVRATWGVNPMIYMSAAMIPTGDWSAVVATNAGLWVAGYPRGYMGDRLRDPGSVPYSVSPWPFAAAWQYSSSGAVGGISGAVDVNWFYGDAVTWTKYAGVPASSVTSNATTPPKNNKTNGAPVADANTLASAVIRGEYGNDPQRRQLLGSRYTEVMAIVNRRLAGSSGSVSGNNGGAYCVVVSSGDTMGAIASRTGRTPASAWSVPSGNINRIWPGQRVCYGGSTASSVGAHVVGTSHVVTAGESLWAIYGSAGWQAAAHRNGLSYPYIIHPGQVLR

SEQ ID NO: 1912 - protein, 290 aa, Bifidobacterium catenulatum
MESMTSPTKRHQSHSNWIRVFVNRVHERTGVWPLGYVSAAFIPQIPADVRANCGLWVAQYANNNPTGWQPRPWNYGKYGEAMRQYTSNGRINGYNGPLDLNYFRGIREQWDKYANPSKTAKPSPTPAPQPAPSVDYEALATATIRGDYGNGEARKAALGANYGPVMRIVNQRLDRSAAYATAASTRSVSVTVRSGDTMSGIAKRTGLWPVTAWSVPSGNINLIYPGNVVTYQGAATAASSGSAATGGRVHVVRSGETLSGIFGANGCQRVAQLNNLANPNLIYPGQRLRY

SEQ ID NO: 1913 - protein, 289 aa, Bifidobacterium adolescentis
MESMTSPTKRHQSHSNWIRVFVNRVHERTGVWPLVYVSAAFIPQIPADVRANCGLWVAQYANNNPTGWQPRPWNYGKYGEAMRQYTSNGRISGYNGPLDLSYFRGTREQWDKYANPSKTAKPTPTTAPQPAPSVDYEALATATIRGDYGNGKARKAALGANYGPVMRIVNQRLDGSAAYAPAASARSVSVTVRSGDTMSGIAKRTGLWSLSAWSVPSGNINLIYPGNIVTYRGTATATRGSATTGGRVHVVKSGETLSGIFGANGWQRVAQLNNLANPNLIYPGQRLRY

SEQ ID NO: 1914 - protein, 288 aa, Bifidobacterium longum
MAVGGDEMQESACLRHQFVGVVNVHERTGVWPLVYVSAAFIPQIPADVRANCGLWVAQYANNNPTGWQSRPWNYGKYGEAMRQYTSNGRINGYNGPLDLNYFRGTREQWDKYANPNKASKPTPAPAPRPAPGVDYEALATATIRGDYDNGEARRAALGANYGPVMRIVNQRLNESAYAPAASTRSVSVTVRSGDTMSGIATRTGLWPLSAWSVPSGNINLIYPGNIVTYRGAATVASSGSVATGGRVHVVKSGETLSGIFGASGWQRVAQLNNLANPNLIYPGQRLRY

SEQ ID NO: 1915 - protein, 403 aa, unidentified
  REGION 1..403: note = Bifidobacterium aerophilum
MPVALLLAVTPVMALADSGVDVSNWQGCVNTSRAENAKNAGASFAFVKVTEGVGYTDKSADCSMAGFANAGIRRGVYHFARPNLGNTPEAEADWFISQTKGYVNQGVIPVLDWEPGGKWNTQTWWAKRWLDRVQAAWGVKPLIYMSASVVQSGDWTEVAQADYGLWVAGYPRGYAGDRLRDPGNVPYSVSPWKFAAAWQYSSSGNVAGVGQAVDVNWFYGDAVTWAKYAGQADTKPVTPPTVAPSEPKPSTPTGDTDSIARAVIRGEYGNMPQRKQLLGSRFDEVQARVDQLLASNGSGSSTSSGSTSVTVRAGDTMSAIAARTGLYPLSAWSVPSGNINRIWPGQTVTYRGAAPSVTTSTPSGHVVRAGESLWSIYGTGWQAAAARNGISYPYLIYPGQVLR

SEQ ID NO: 1916 - protein, 463 aa, unidentified
  REGION 1..463: note = Bifidobacterium sp. N5G01
MCASRSSKPTTAAVSHPTTGTTDHNNNKERKGMTTANKGTPKHAKPRRRYRQPTVALLIAACLAIAPCAMADTGIDTASYQGCWNGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKSTWGVNPMIYMSAAMIPTGDWSAVVATNAGLWVAGYPRGYMGDRLRDPGSVPYSVSPWPFAAAWQYSSSGAVGGISGAVDVNWFYGDAVTWAKYAGAPASSVTSNATTPPPNNKTNGAPVADANTLASAVIRGEYGNDPQRRQLLGSRYTEVMAIVNRRLAGSSGSVSGNNGGAYCVVVSSGDTMGAIASRTGRTPASAWSVPSGNINRIWPGQQVCYGGSTASNVGAHVVGTSHVVTAGESLWTIYGATGWQAAAQRNGLSYPYIIHPGQVLR

SEQ ID NO: 1917 - protein, 404 aa, unidentified
  REGION 1..404: note = Caudoviricetes sp.
MKYKLTKTARRIGLVIATVIVAMAMAIPANAANLIDISDWQRGINITTTGADIVVVKATESTTYVNTDCDRVVQQALSTDKGVGVYHFANTRNDPLAEADFFVQQTQGYIGKGIVPILDWEPGGPGNISWALTWLNRVESRWGAKPIIYMSQNTENKYDWTPVVQQNYGLWIAAYTLGFQPIYGFHPPNAQPVMKHWPFAVAWQYTSSGHVDGWPGNVDLSVVYGSIDTWRAYASGTGTIPAPPYPPKVTTPSSPSVDGTDEQLADRVMRGEFGSIPERQRRLGSRYASVQAIVNARLGQSGAGAASGVCVVVRSGDTLSGIAARTGKTPYTMWGGYRSGNPNVLYAGETVCYRGANTGNQSSSGHVVRAGESLWAIYGSGWANAAARNGIRAPYVIHPGQILR

SEQ ID NO: 1918 - protein, 460 aa, Bifidobacterium adolescentis
MCASRSSKPTTAAVSHPTTGITDRQERKRMTTANKGTPKHAKPRRRYRQPMVALLVAACLAIAPCAMADTGIDTASYQGCWNGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVSPWPFAAAWQYSSSGAVGGISGAVDVNWFYGDAVTWAKYAGAPASSVTPNATTPPPNNKTNGAPVADANTLASAVIRGEYGNDPQRRQLLGSRYTEVMAIVNRRLAGSSGSVSGNNGGAYCVVVSSGDTMGAIASRTGRTPASAWSVPSGNINRIWPGQQVCYGGSTASSVGAHVVGTSHVVTAGESLWTIYGATGWQAAAQRNGLSYPYIIYPGQVLR

SEQ ID NO: 1919 - protein, 430 aa, Bifidobacterium adolescentis
MKILNKSHPKHKKVSRDWRKPFAAAMIAVCMIVAPVASADTGVDTASYQGCWNGAQAKAAGVNFAFIKLNQGTGYVNPYANCQLDAARSAGIREGAYDFASPQTSTPEAEADKFVSEARARGMIGRAIPVLDWEPSAPGGYWGKQTWWALRWVNRVKATWGVNPLIYMSAGMIPTGDWSAVVATNAGLWVAGYPAGYTGDRLRNPGAVPYSVSPWPFAAAWQYSSSGSVGGISGAVDVNWFYGDAVTWSKYAGAPASSVTSNTTTPPKNNKTNGAPVASADVLASSVIRGEYGNDPQRRQLLGSRYSEVMAIVNRRLAGSGGAVAGNSGGAYCVVVGSGDTMSAIANRTSHTPASAWSVPSGNINRIYPGNRVCYGGTTASSVGAHVTGTSHVVTAGESLWKIYGAGWYAAAQRNGLRSPYTIYPGQALH

SEQ ID NO: 1920 - protein, 433 aa, Bifidobacterium adolescentis
MNILNKGKPKHKHMNPRRQWRKLLTALTVAISMAVAPAAMADTGIDTASYQGCWDGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVNPWPFAAAWQYSSSGAVGGIGGAVDVNWFYGDAVTWAKYAGAPASSVTSNATTPPENNKTNGAPVADANTLASAVIRGEYGNDPQRRQLLGSRYTEVMAIVNRRLAGSSGSVSGNNGGAYCVVVSSGDTMSAIASRTGRTPASAWSVPSGNINRIWPGQQVCYGGSTASSVGAHVVGTSHVVTAGESLWAIYGPSGWQAAAQRNGLSYPYVIHPGQVLR

SEQ ID NO: 1921 - protein, 400 aa, Bifidobacterium bifidum
MPKLRKQFAAIAAILLAACMTVPLALADMNGIDVSGWQSPTVTCTADYDFAVVKATQGTGFTNGYMTSQTRCVKQRGKSLGFYHYAGGGNATREADHFVNTVRPYVGEAVLVLDWESYQNAAWGNSNWIRVFVNQVHDRTGVWPLVYVSAAFIPQIPADVRANCGLWVAQYANNNPTGWQYRPWNYGKYGEAMRQYTSNGRINGYNGPLDLNYFRGTREQWDKYANPGKISKPTPTPAPQPAPSVDYEALATATIRGDYGNGEARRAALGATYGTVMRIVNQRLNGFAVYAPAASTRSVSVTVRRGDTMSGIAKRTGLWPLSAWSVPSGNINLIYPGNIVTYRGTATASSGSATTGSRVHVVKSGETLSGIFGANGWQRVARLNNLANPNLIYPGQRIRY

SEQ ID NO: 1922 - protein, 433 aa, Bifidobacterium dentium
MNILNKGKPKHKRMNPRRQWRKLLTALAVAASMAVAPAAMADTGIDTASYQGCWDGAQAKSSGVNFAFIKLNQGTGYANPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVNPWPFAAAWQYSSSGAVGGIGGAVDVNWFYGDAVTWAKYAGAPASSVTSNATTPPENNKTNGAPVADANTLASAVIRGEYGNDPQRRQLLGSRYTEVMAIVNRRLAGSSGSVSGNNGGAYCVVVSSGDTMSAIASRTGRTPASAWSVPSGNINRIWPGQQVCYGGSTASSVGAHVVGTSHVVTAGESLWAIYGPSGWQAAAQRNGLSYPYVIHPGQVLR

SEQ ID NO: 1923 - protein, 431 aa, unidentified
  REGION 1..431: note = Bifidobacterium sp. N5G01
MTTANKGTPKHAKPRRRYRQPTVALLIAACLAIAPCAMADTGIDTASYQGCWNGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKSTWGVNPMIYMSAAMIPTGDWSAVVATNAGLWVAGYPRGYMGDRLRDPGSVPYSVSPWPFAAAWQYSSSGAVGGISGAVDVNWFYGDAVTWAKYAGAPASSVTSNATTPPPNNKTNGAPVADANTLASAVIRGEYGNDPQRRQLLGSRYTEVMAIVNRRLAGSSGSVSGNNGGAYCVVVSSGDTMGAIASRTGRTPASAWSVPSGNINRIWPGQQVCYGGSTASNVGAHVVGTSHVVTAGESLWTIYGATGWQAAAQRNGLSYPYIIHPGQVLR

SEQ ID NO: 1924 - protein, 431 aa, Bifidobacterium adolescentis
MTTANKGTPKHAKPRRRYRQPMVALLVAACLAIAPCAMADTGIDTASYQGCWNGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVSPWPFAAAWQYSSSGAVGGISGAVDVNWFYGDAVTWAKYAGAPASSVTPNATTPPPNNKTNGAPVADANTLASAVIRGEYGNDPQRRQLLGSRYTEVMAIVNRRLAGSSGSVSGNNGGAYCVVVSSGDTMGAIASRTGRTPASAWSVPSGNINRIWPGQQVCYGGSTASSVGAHVVGTSHVVTAGESLWTIYGATGWQAAAQRNGLSYPYIIYPGQVLR

SEQ ID NO: 1925 - protein, 430 aa, Bifidobacterium adolescentis
MKILNKSHPKHKRLPRDWRKPFAAAMIAICMIVAPVASADTGVDTASYQGCWNGAQAKAAGVNFAFIKLNQGTGYVNPYANCQLDAARSAGIREGAYDFASPQTSTPEAEADKFVSEARARGMVGRAIPVLDWEPSAPGGYWGKQTWWALRWVNRVKATWGVNPMIYMSAAMIPTGDWSAVVATNAGLWVAGYPRGYMGDRLRNPGSVPYSVSPWPFAAAWQYSSSGAVGGISGAVDVNWFYGDAVTWAKYAGAPASSVTSNATTPPPNNKTNGAPVADANTLASAVIRGEYGNDPQRRQLLGSRYAEVMAIVNRRLAGSSGSVSGNNGGAYCVVVSSGDTMSAIAARSGRTPASAWSVPSGNINRIWPGQQVCYGGSTASSVGAHVVTTSHVVTAGESLWKIYGSGWPAAAQRNGLRAPYTIYPGQVLH

SEQ ID NO: 1926 - protein, 433 aa, Bifidobacterium adolescentis
MNILNKGKPKHKHMNPRRQWRKLLTALTVAISMAVAPAAMADTGIDTASYQGCWDGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNSVKATWGVNPMIYMSAAMIPTGDWSAVVATNAGLWVAGYPRGYAGDRLRNPGAVPYSVNPWPFAAAWQYSSSGAVGGIGGAVDVNWFYGDAVTWAKYAGAPASSVTSNATTPPENNKTNGAPVADANTLASAVIRGEYGNDPQRRQLLGSRYTEVMAIVNRRLAGSSGSVSGNNGGAYCVVVSSGDTMSAIASRTGRTPASAWSVPSGNINRIWPGQQVCYGGSTASSVGAHVVGTSHVVTAGESLWAIYGPSGWQAAAQRNGLSYPYVIHPGQVLR

SEQ ID NO: 1927 - protein, 466 aa, unidentified
  REGION 1..466: note = Streptococcus parasuis
MAINIETAIRWMSDRKGRVTYSMDYRNGPNSYDCSSAVYYALMAGGASSAGWAVNTEYEHDWLLKNGFKLIAENQDWDAKRGDVFIWGKRGQSSGAGGHTGIFIDPDNIIHCNYAHNGITVNNYNQTAAASGWMYCYVYRLTNQASVSGKSLETLVQETLAGKHGNGDQRKASLGNQYEAVMAVINGKTTTNQKTDEELAKEVIAGKHGNGEERKRSLGSRYEAVQKKVDELLKKPTSPQPTPKVEAPKVEPPKVEPPVFAEDGDLKFNGAILKKEVLNKILAKCKEHNILPSYAITILHYEGLWGTSAVGKADNNWGGMTMPSNDLQITRPSGVVVTRGLARPSNEGGYYMHYTSVDDFLTDWFWLLRKDGSYKVSGARTFSEAVKGMFKVGGAKYDYAASGYKSYLVGASSRLKAIESENGSLTKFDALSNNVNSVDPDKITVNIEGIEIEINGVKYTISKKPV

SEQ ID NO: 1928 - protein, 427 aa, unidentified
  REGION 1..427: note = Bifidobacterium sp. MSK.17.10
GKPKHKRMNPRRQWRKLLTALAVAISMAVAPAAMADTGIDTASYQGCWDGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKATWGVNPMIYMSAAMIPTGDWSAVVATNAGLWVAGYPRGYAGDRLRNPGAVPYSVSPWPFAAAWQYSSSGAVGGIGGAVDVNWFYGDAVTWAKYAGAPASSVTSNATTPPENNKTNGAPVADANTLASAVIRGEYGNDPQRRQLLGSRYTEVMAIVNRRLAGSSGSVSGNNGGAYCVVVSSGDTMSAIASRTGRTPASAWSVPSGNINRIWPGQQVCYGGSTASSVGAHVVGTSHVVTAGESLWAIYGPSGWQAAAQRNGLSYPYVIHPGQVLR

SEQ ID NO: 1929 - protein, 282 aa, Bifidobacterium breve
MQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGLVMSIVNQRLNGSTAYTPAASTRSVSVTVRSGDTMSGIATRTGLWPLSAWSVPSGNINLIYPGNIVTYRGAATVASSGSVATGGRVHVVKSGETLSGIFGASGWQRVAQLNNLANPNLIYPGQRLRY

SEQ ID NO: 1930 - protein, 421 aa, unidentified
  REGION 1..421: note = Bifidobacterium aerophilum
MDHRTHIRNKGKPWRLIAMPVALLLAVTPVMALADSGVDVSNWQGCVNTSRAENAKNAGASFAFVKVTEGVGYTDKSADCSMAGFANAGIRRGVYHFARPNLGNTPEAEADWFISQTKGYVNQGVIPVLDWEPGGKWNTQTWWAKRWLDRVQAAWGVKPLIYMSASVVQSGDWTEVAQADYGLWVAGYPRGYAGDRLRDPGNVPYSVSPWKFAAAWQYSSSGNVAGVGQAVDVNWFYGDAVTWAKYAGQADTKPVTPPTVAPSEPKPSTPTGDTDSIARAVIRGEYGNMPQRKQLLGSRFDEVQARVDQLLASNGSGSSTSSGSTSVTVRAGDTMSAIAARTGLYPLSAWSVPSGNINRIWPGQTVTYRGAAPSVTTSTPSGHVVRAGESLWSIYGTGWQAAAARNGISYPYLIYPGQVLR

SEQ ID NO: 1931 - protein, 259 aa, Bifidobacterium longum
MQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGLVMSIVNQRLNGSTAYTPAASIRSVSVTVRSGNINLIYPGNIVTYRGAATVASSGSVATGGRVHVVKSGETLSGIFGASGWQRVAQLNNLANPNLIYPGQRLRY

SEQ ID NO: 1932 - protein, 286 aa, Bifidobacterium adolescentis
MTSPTKRHQSHSNWIRVFVNRVHERTGVWPLVYVSAAFIPQIPADVRANCGLWVAQYANNNPTGWQPRPWNYGKYGEAMRQYTSNGRISGYNGPLDLSYFRGTREQWDKYANPSKTAKPTPTTAPQPAPSVDYEALATATIRGDYGNGKARKAALGANYGPVMRIVNQRLDGSAAYAPAASARSVSVTVRSGDTMSGIAKRTGLWSLSAWSVPSGNINLIYPGNIVTYRGTATATRGSATTGGRVHVVKSGETLSGIFGANGWQRVAQLNNLANPNLIYPGQRLRY

SEQ ID NO: 1933 - protein, 287 aa, Bifidobacterium catenulatum
MTSPTKRHQSHSNWIRVFVNRVHERTGVWPLGYVSAAFIPQIPADVRANCGLWVAQYANNNPTGWQPRPWNYGKYGEAMRQYTSNGRINGYNGPLDLNYFRGIREQWDKYANPSKTAKPSPTPAPQPAPSVDYEALATATIRGDYGNGEARKAALGANYGPVMRIVNQRLDRSAAYATAASTRSVSVTVRSGDTMSGIAKRTGLWPVTAWSVPSGNINLIYPGNVVTYQGAATAASSGSAATGGRVHVVKSGETLSGIFGANGCQRVAQLNNLANPNLIYPGQRLRY

SEQ ID NO: 1934 - protein, 183 aa, Bifidobacterium sp.
MRANCGLWVAQYANNNPTGWQPRPWNYGKYGEAMRQYTSNGRISGYNGPLDLNYFRGTREQWDKYANPSKTAKPSPTPAPQPAPSVDYEALATATIRGDYGNGKARKAALGANYGPVMRVVNQRLDGSAAYAPAASTRSVSVTVRSGDTMSGIAKRTGLWPLSAWSVPSGNINLIYPGNIVTY

SEQ ID NO: 1935 - protein, 429 aa, Bifidobacterium adolescentis
MTTANKGTPRHAKPRRRYRQPTVALLIAACLAIAPCAMADTGIDTASYQGCWNGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKSTWGVNPMIYMSAAMIPTGDWSAVVATNAGLWVAGYPRGYMGDRLRDPGSVPYSVSPWPFAAAWQYSSSGAVGGVSGAVDVNWFYGDAVTWAKYAGAPASSVTSNATTPPENNKTNGAPVADANTLASAVIRGEYGNDPQRRQLLGSRYTEVMAIVNRRLSGSGVTTPSGNTGYCVVVSSGDTMGAIASRTGRTPASAWSVPSGNINRIWPGQRVCYGGSTASNVGARTVGASHVVTAGESLWKIYGSGWPAAAQRNGLRAPYTIYPGQVLH

SEQ ID NO: 1936 - protein, 288 aa, Bifidobacterium breve
MAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKTSKPTPTPAPQPAPSVDYEALATATIRGDYGNGEARRAALGANYGPVMRIVNQRFNGSAAYAPAASTRSVSVTVRSGDTMSGIAKRTGLWPLSAWSVPSGNINLIYPGNIVTYRGAATATSGSAATGGRVHVVKSGETLSGIFGANGWQRVAKLNNLANPNLIYPGQRIRY

SEQ ID NO: 1937 - protein, 282 aa, Bifidobacterium longum
MQESACLRHQFVGVVNVHERTGVWPLVYVSAAFIPQIPADVRANCGLWVAQYANNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGLVMSIVNQRLNGSTAYTPAASTRSVSVTVRSGDTMSGIATRTGLWPLSAWSVPSGNINLIYPGNIVTYRGAATVASSGSVATGGRVHVVKSGETLSGIFGASGWQRVAQLNNLANPNLIYPGQRLRY

SEQ ID NO: 1938 - protein, 289 aa, Bifidobacterium longum
MAVGGDEMQESACLRHQFVGVVNVHERTGVWPLVYVSAAFIPQIPADVRANCGLWVAQYANNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGLVMSIVNQRLNGSTAYTPAASTRSVSVTVRSGDTMSGIATRTGLWPLSAWSVPSGNINLIYPGNIVTYRGAATVASSGSVATGGRVHVVKSGETLSGIFGASGWQRVAQLNNLANPNLIYPGQRLRY

SEQ ID NO: 1939 - protein, 266 aa, Bifidobacterium longum
MAVGGDEMQESACLRHQFVGVVNVHERTGVWPLVYVSAAFIPQIPADVRANCGLWVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGLVMSIVNQRLNGSTAYTPAASIRSVSVTVRSGNINLIYPGNIVTYRGAATVASSGSVATGGRVHVVKSGETLSGIFGASGWQRVAQLNNLANPNLIYPGQRLRY

SEQ ID NO: 1940 - protein, 289 aa, Bifidobacterium breve
MAVGGDEMQESACLRHQFVGVVNVHERTGVWPLVYVSAAFIPQIPADVRANCGLRVAQYTNNNPTGWQSRPWNYGKYGEAMRQYTSNGRINGYNGPLDLNYFRGTREQWDKYANPGKSFKPTPMPAPQPAPSVDYEALATATIRGDYGNGEARRAALGANYGLVMSIVNQRLNGSTAYTPAASTRSVSVTVRSGDTMSGIATRTGLWPLSAWSVPSGNINLIYPGNIVTYRGAATVASSGSVATGGRVHVVKSGETLSGIFGASGWQRVAQLNNLANPNLIYPGQRLRY

SEQ ID NO: 1941 - protein, 448 aa, Bifidobacterium sp.
MTKDNAKVIRQSDVSLPATVHVEVRPGQQIVATAQNGTSAQPLTVSVKADGKHASDAGRGYNNVSETTLTAADSAPASKAASLWGVDTSHWQRDINYLGAGDFGIIKVGGSDIGYNYRDPMFKASQSKLRSSGKLVGYYWFAGYSSATSEADAFVSYLGGSYQCGQPVVYDSEAQFVSPAKTHAFLSRVSDRLGWDCVNRYLYTSSSNTRTYNWASVATIARLWVANYGSNNGSYQYSPAVGHWASWTIHQYTSRGRISSYAGNVDLNVAATDAWHGVTGQSSVSPTPAPTVNNAGAIDYEALATNVIQGKYGNGSTRRTLLGSRYTAVMAIVNRRLARTPNAGTSSSAWYVVKSGDYLSKVWPHNWRSIATLNGLRRPYTIYVGQRLRTSGSTATASAVTSSGTYRIQSGDTLGKLATRWGASVSYLARINHITNINRIYAGQTLRH

SEQ ID NO: 1942 - protein, 403 aa, Bifidobacterium sp.
MKKKLPALVAATAAISMLTPAAALADVGFDAASYQGCYNAQATVNAGARFAMIKITQGNYYRNGSRVCQFDSSRAAGLRLAAYGFADTSVSPQADAAFFNAEADRMGLVGHGVLPVLDWEPASPGNVAWARTWLDVVSSHWGTKPLIYMSASTIGRADWSSVANADYGLWVAGYPNGYAGDRLRNPGYPPYSVGPWPFAAAWQYSSTGSVPGVGGAVDVDWFYGDAVTWAKYANAPLSTVTRPASGSTPSGVSPVQTTTTPTGSADALATAVIQGLYGNQPQRQRLLGSRYAEVMSIVNRRLNGAVTSSGSYVVRSGDYLSKVWPSTWPTVAALNGLRPPYTIYVGQRLRTTGAAASAGRRYTVRSGDTLGAIARRLGVSTGSIHGYRSGNPNLIYVGETIAY

SEQ ID NO: 1943 - protein, 232 aa, Bifidobacterium adolescentis
MAGYPRGYAADRLRNPGAPPYSVSPWPFAAAWQYSSSGNVPGIGSRIDVNWFYGDAVTWSRYAGGSGTTHAVTPPAGTANSDMPVGDTESLARAVIRGEYGNLPQRRILLGNRFNEVQARVNQILAGNNGGGNTGGGVDLNMVARRIIRGDFGNQPQRQPRVDATYGAGTYAKAQAIVNGSAAPAGNASGRVYVVKPGDCLSRVFPGNWQTVARANGIANPNLIYPGQWIHY

SEQ ID NO: 1944 - protein, 413 aa, unidentified
  REGION 1..413: note = Streptococcus ruminantium
MGIDFETSIRWMMDRVGRVTYSMDYRNGPDSYDCSSAVYYALTAGGAISAGWAVNTEYEHDWLMNNGFELVAENTAWDAKCGDVFIWGRRGESAGAGGHTGIFVDGDNIIHCNYKRNSISVDEHDITWSYAGRPYYYVYRLKDQAKTNPSNQKTDEELAKEVIAGLHGFGEERKHSLGSRYDAVQAKVNEILKGDSKPSETIQNVPQTVQIKEDGDLSFNGAILKKSVLDIILRKCKEHDILPSYAITVLHFEGLWGTSTVGRRDNNWGGMTWTGQGNRPSGITVTQGTARPSNEGGYYMHYATIEDFLTDWFYLLRADGSYKVSGAKTFSEAVKGMFQVGGAVYDYAAAGYDNYLVGMASRLKAIEAENGSLEKFDKATDISDGSKDKIDISIEGIEVTINGVTYKLEKKPI

SEQ ID NO: 1945 - protein, 413 aa, unidentified
  REGION 1..413: note = Streptococcus ruminantium
MALNIETSIRWMSSRAGKVSYSMDYRNGPDSYDCSSAVYYALTAGGAISAGWAVNTEYEHDWLIKNGFELIAENTAWDAKCGDVFIWGRRGESAGADGHTGIFVDGDNIIHCNYAHNGISVNEHDATWSYAGRPYYYVYRLKDQSETTTSNQKTDEELAKEVIAGLHGFGEERKYSLGSRYDAVQAKVNEILKGDSKPSETIQNVPQTIQIKEEGDLSFNGAILKKSVLDIILRKCKEHDILPSYAITVLHFEGLWGTSSVGKADNNWGGMTWTGNGNRPSGITVTQGTARPSNEGGYYMHYATIEDFLTDWFYLLRAGGSYKVSGAKTFSEAVKGMFKVGGAVYDYAASGFDSYIVGASSRLKAIEAENGSLDKFDKATDIGDGSKDKIDITIEGIEVTINGITYELTKKPV

SEQ ID NO: 1946 - protein, 415 aa, unidentified
  REGION 1..415: note = Streptococcus ruminantium
MTTAIEAVNFAKDLANQGKGVDFDGYYGKQCVDLPNWICGKFFGKALWGNAIDLLNSAEQHGFDVHRMPTSERPHPGALFVKSYVAGDGIDYGHTGIIIDVDGDTVQTVEQNLVGDLSVGGPAQYASQRIDNLVGWFYPPYADSGQSEPDQMMEKTDEELAQEVIAGFHGFGEERKHSLGSRYDAVQTKVNEILNGSLSAAEELKEEPQAVQFKEDEDLSFNGAILKKSVLDIILRKCKEHDILPSYAITVLHFEGLWGTSSVGKADNNWGGMTWTGKGERPSGVTVTKGSARPSNEGGHYMHYASVDDFLTDWFYLLRSGGSYKVSGAKTFSEAIKGMFKTGGAVYDYAASGFDSYIVGASSRLKAIESENGSLDKFDKQIVTDVAQSDKIEVNIEGIEISINGVTYELTKKPV

SEQ ID NO: 1947 - protein, 212 aa, Bifidobacterium adolescentis
MGFVHSSFAAAWQYSSSGNVPGIGGRIDANWFYGDAVTWSRYANGSGTTHTVTPPASTANSATPVGDTESLARAVIRGEYGNLPQRRILLGNRFNEVQARVNQILAGNNGGGNTGGGVDLNMVARRIIRGDFGNQPQRQPRVDATYGAGTYAKAQAIVNGSAAPAGNAGGRVYVVKPGDCLSRVFPGNWQTVARANGIANPNLIYPGQWIHY

SEQ ID NO: 1948 - protein, 186 aa, Bifidobacterium catenulatum
MAPANSGTNTPTQAKPKPSPTPAPQSAPSVDYEVLATATIRGDYGNGEARRAALGANYGPVMRIVNQRLNGSAAYAPAASTRSVNVTVRNGDTMFGIAKRTGLWPLSAWSVPSGNINLIYPGNIVTYRGTATSTSSGSIATGGRVHIVKSGETLSDIFGANGWQRVAQLNNLANPNLIYPGQQLRY

SEQ ID NO: 1949 - protein, 103 aa, Actinomyces sp.
MRLRRGRKGYYTWRLPDIDVTQYSTDALAEAVLRGELGDGIDRMQVLGHKYDDVQTLVNRKIDGYARRVLAGEFGDGRERRLRLGYLYPAVQARVNEIVNVKY

SEQ ID NO: 1950 - protein, 268 aa, unidentified
  REGION 1..268: note = Caudoviricetes sp.
MSNSSLIQDKILSPNHSGKRSEKICKIAIHHAAGVINGRNLASLFVSKTRKASANYCLGSDGVIILGVDERNRAWTTSSSWCDNRAVTIEVGNSTCAPQWLVSNYVLKRLIDLVTDICRRNEIYPCTYTGGKDGVLQKHEWYKSTNCPGPYLGSKFPYIASEVNKRLRGDKTVSKPTSGLYRVRKSWSDVKSQKGAFRNIENAKRCAGFRLKVFDANGNIVYPVGKTIDELAREVISGKWGNGDERKRRLTNAGYDYYAIQKRVNKLI

SEQ ID NO: 1951 - protein, 269 aa, unidentified
  REGION 1..269: note = Tissierellia bacterium S5-A11
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLKRLIDLVTDICRRNGIYPCTYTGGKDGVLQKHEWYKNTNCPGPYLGSKFPYIANEVNKRLRGNNTVSKPTGGLYRVRKSWSDVKSQKGAFKNLENAKRCADRFRLKVFDANGKIVYPVGKTIDQLAREVISGKWGNGEERKRRLTNAGYDYYVIQKRVNELI

SEQ ID NO: 1952 - protein, 500 aa, unidentified
  REGION 1..500: note = Aerococcaceae bacterium DSM 111022
MAQELLKIADGYLGVNQYDARHRALVADYNRVSPLPVGYPLKVEDDWCAAFVTVVGDKLGIAGLIPRECGVQRQILLCQDMGIWIGRELPQPGDLIFWDWNQNAWSDHVGFVESVSADGYVTTIEGNSNRRVEKNIFHYLATSISGYARPRYLAESADGNAVRLVVPASVVDAVMRGEYGNGSERVRRLRDAGYDPDAVQEEVNKRVTLSKSNDKQTPIHTSTVTEIAREVIAGKWDNGGQRLKLLMAAGHDPAEVQREVNRLMLEAEPIRASVTEIAREVVAGKWGMGADRVERLKSAGHDAVAVQKEVNRLMGVESASADRALEVVSLPVGKKYQGLHYQSRSISGDLVGFIHEEAKLYDIEPMFLITMLDYEGLWGSSRVAKTDNNWAGITWSETYKGHPDVVKFKGSARPSNEGGNYIHYQSVKDFLRDWIYLLRPNHTYKVSGKKTLTEFVKGLFRVGGAKFDYAAIGYPDYLNGMVARYKGIMSVNADIVGRAA

SEQ ID NO: 1953 - protein, 108 aa, unidentified
  REGION 1..108: note = Lachnospiraceae bacterium
MLSGSKPTTPQKSIDELAKEVLAGKWGNGNDRKNALTNAGYNYSAVQARVNELVKGSSESKAEYYTVKSGDTLSGIAKKYGTTYQKLAQMNGIKNPNIIYAGQKIRVR

SEQ ID NO: 1954 - protein, 328 aa, unidentified
  REGION 1..328: note = Clostridia bacterium
MKIIEKILTKNPCYIAGRKITVKGLMLHSVGCPQPSAMVFVNNWNPPANGREVCVHGFIDANTGEVYQTLPWDHRGWHGGGSSNNTHIGVEMCEPACIKYTGGSTFTCSDTATAKAAVKRTYEAAVELFAFLCKQYKLDPLADGVIISHKEGHKRGIASNHGDPEHLWTQLKTGYTMDGFRKDVKAAMAEEEKPTAPATPKVLYRVQVGAYRVKSNADAQLKKVKAAGFDTYMVQAGGLYKIQVGAYSVKANAEAMLKKVKAKGFSAYITTATGTAVAATTAAKKSIDEIAKEVIKGKWGNGAERKQKLTAAGYNYSAVQKRVNELCK

SEQ ID NO: 1955 - protein, 269 aa, Anaerococcus sp.
MSNSPLVQARILSPNHSGRRNQKITKIAIHHAAGVINGRNLAGVFVPRSRRASANYNLGSDGVIVLGVDESNRPWTTSSSWCDNRAVTIEVGNSTRGPQWLVSDYVLNRLIDLVADICRRNGIYPCTYTGGKDGVLQKHEWYSNTNCPGPYLGSKFPYIAREVNKRLRGNNTISKSIGGLYRVRKYWSDVKSQKGAFKNLDNAKRCADRFRLKVFDANGKIVYPVGKTIDELAKEVISGKWGNGAERKRRLTQAGYDYKVVQKRVNQLI

SEQ ID NO: 1956 - protein, 389 aa, Ruminococcus sp.
VEECNRAWTSSSADNDNQAVTIEIANDGGAPNWHVSDAALAAAIELCVDVCKRNGIAKLNFTGDKSGNLTMHKYFAATGCPGPYLESKFPYIASEVNKRLGADTAAQTANFTPRLTAPSASDKHWLHTSKGGLNECIHISGGSVLPNCVGYAWGRFYEIIGEKPSLSKNNAEMWYGSTADGYKRSQTPELGAVACWSKGAVGSEADGAGHVAVVERIEANGDIVTSNSAYGGSRFYTQVYKKSAGYNFGAYKFQGFILPVKIKNVTVTSAANSGSSAAFKVGDIVNFTGTTHYASSTGTRGTACKSGRAKITRISANAAHPYHLVNDGSGSTVYGWVNAADIAAEKSLDELAREVIRGDWGNGDERKKRLTEAGYDYTAVQKRVGELMK

SEQ ID NO: 1957 - protein, 246 aa, Ruminococcus sp.
MTKIKGVDISVYQKGISFSALKQAGVKFAIIRAGYGEKKDYTMDKFVEDCTANGIDFGFYWYSYAMSVKQAEAEAEKCAAVLKGLSPTYPVFFDMEEKKQISGLNTDTRTRMAIAFCEKIRQAGFKPGIYANPSFMENYYDKQRLVGKYDIWLAHWTNSPDRPSRYNYGQIMWQWGLDRIDGYDFDGDICFCEYAKPDPAKKTVDELAREVIRGDWGNGAERRERLTAAGYDYSEVQRKVNQLIKQ

SEQ ID NO: 1958 - protein, 313 aa, unidentified
  REGION 1..313: note = Clostridiales bacterium
MAYEYITRYDSPNFTRGREGNKPQYIVIHHWGQDGASFWGVVNWLCRQGGNSSAHYVVEAGKVACIVDPDDTAWHAGNWWYNLRSIGIECRPEMSDGDLATVAELIKEIWKAYGKLPIIGHKDIVSTACPGRYYAKLSTLKSMAESGNVSAPKPQPKPKPQGKKSIDTLVKEVLQGMWGNGQARFDALRRAGYDPQAVQNGVNARILGTTAPPARKATKSTTDIAQEVLAGNWGVGSDRVARLTNAGYNYNAVQAEVNRLCGLKAPTGKTIDQVAREVIRGDWGNGSDRRNRLTRAGYNYQAVQARVEQLFYS

SEQ ID NO: 1959 - protein, 217 aa, unidentified
  REGION 1..217: note = Oscillospiraceae bacterium
DKRSPNPQLGAVACWRKGKVRNPSDGCGHVAVVEKIEPNGDIITSESDYGGVRFVTRTYKKSSGYNSGALVFQGFILPPVEFEVNDNVVSNTNTSNKVSVDKIKIGDIVTFNGGEVYGSSSAANSTREICKISKVKITIIALNTKHPYHAISQDGVGVHGWINESSIQSVNEKSVDEIAQEVIVGKWGNGNERKQRLETAGYDYEAVRRRVNELMKK

SEQ ID NO: 1960 - protein, 212 aa, Eubacterium sp.
MDFCSGLIKTFCSKLEAAGYFAGFYTSSSYVRAVVKEEIRKRYSFWCAQWASSCSFAGSCGIWQYSSNGTVPGISGRVDLDYAYQDFPIIIMNGGFNGYKASTKNPEPQPTSALTIEEAAKKVIAGEFGNGDQRRKAIEALGLSYDAVQKRVNELVSSSAPKQTKVYYSVVSGDTLSGIAAKHGLTLAALLKLNPSIKNPNIIYPGQKIRVK

SEQ ID NO: 1961 - protein, 318 aa, Butyrivibrio sp.
MNLVESILTENPCYKEGRKITVKGLMLHSVGVAQPNAMVFVRSWNTAAHDNSCVHAFIDANDGTIYQTLPWDHRGWHAGGSANNTHIGIEMCEPASLKYVSGAQFTCSDRDGAVIQVERTYNAAVELFAMLCKEYGLDPMEDGVIVSHNEGHSRGIASNHSDPEHLWTQLSTGYTMDSFRRAVKELMDKEVGNANDNYPPTPFSVKVLIDNLNIRAYPNFGDNIKGQTGRGTFTIVEVRNGWGRLKNGIGWIWLEEEAYCTILDHIVADSYEKKSLDEVAMEVINGKWGNGEERKRRLTEAGYDYYAVQKRVNELIWY

SEQ ID NO: 1962 - protein, 269 aa, unidentified
  REGION 1..269: note = Peptoniphilus duerdenii
MSNSPLAQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKKLRGDKTVSKPVGGLYRVRKSWSDPKSQKGAFKNLENAKRCADRFGLKIFDANGKIVYPVGKTIDQLAREVISGKWGNGEERKRRLTNAGYDYYVIQRRVNQLV

SEQ ID NO: 1963 - protein, 322 aa, Allofustis seminis
MSNSPLVNLVNYSPNHSGKRTHPITKIAIHHTAGAVSAATIGHIFKPRARQASCNYGIGNDNKVILVVDEKNRSWCTSSAWCDNRAVTIEVANSRNGGNWPVSDRVLATLIDLVTDICRRNGIKDCSYTGGKDGVLQKHEWYSNTNCPGPYLGSLFPYISREVNKRLRGNTQAPNSIKSNQLYRVRKTWQDAKSQKGAFRNLNNAKACVNKYKGYRVFDGSGRQVYPVEKTKKSIDAIAREVINGKWGNGDERKRRLSQAGYDYNTVQEKVNEIISVGKKSVDIIAREVINGKWGNGVERKRRLTQAGYNYNQIQKKVNELL

SEQ ID NO: 1964 - protein, 269 aa, unidentified
  REGION 1..269: note = Criibacterium bergeronii
MSNSPLVQATILSPNHSGRRNQKITKIAIHHAAGVINGRNLAGVFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGNKFPYIAREVNKRLRGDNTVSKPTGGLYRVRKSWSDSKSQKGAFKNLENAKRCADRFGLKVFDVNGKMVYPVGKTIDQLAREVISGKWGNGEERKRRLTNAGYDYYAIQKRVNKLI

SEQ ID NO: 1965 - protein, 269 aa, unidentified
  REGION 1..269: note = Anaerococcus sp. Marseille-P9784
MSNSPLVQATILSPNHSGRRNQKITKIAIHHAAGVINGRNLAGVFVPRSRRASANYNLGSDGVIVLGVDESNRAWTTSSSWCDNRAVTIEVGNSTKGPQWLVSDYVLNRLIDLVTDICRRNGIYPCTYTGGKDGVLQKHEWYKNTNCPGPYLGSKFPYIASEVNKRLRGDKTVSKPTSGLYRVRKSWSDTKSQKGAFKNLDNAKRCADRFRLKVFNDNGKIVYPVGKTIDQLAREVISGKWGNGEERKRRLTNAGYDYYVIQKRVNELI

SEQ ID NO: 1966 - protein, 269 aa, unidentified
  REGION 1..269: note = Anaerococcus sp. Marseille-P9784
MSNSSLVQSTILSPNHSGRRNQKITKIAIHHAAGVINGRNLAGVFVPRSRRASANYNLGSDGVIVLGVDESNRAWTTSSSWCDNRAVTIEVGNSTKGPQWLVSDYVLNRLIDLVTDICRRNGIYPCTYTGGKDGVLQKHEWYKNTNCPGPYLGSKFPYIASEVNKRLRGDKTVSKPTSGLYRVRKSWSDTKSQKGAFKNLDNAKRCADRFRLKVFNDNGKIVYPVGKTIDQLAREVISGKWGNGEERKRRLTNAGYDYYVIQKRVNELI

SEQ ID NO: 1967 - protein, 479 aa, unidentified
  REGION 1..479: note = Enterocloster bolteae
MPEKKKGIDISVWQGNIDARQIKNSGIDFAIIREGYRQAVDSRFFDNVKKCKEVGLAVMGVYHFSYALNTEQAKQEAQQTVANLEKAGLSKETIVFFDFEYDTVTKAAAAGVTLGKAECNAHTKAFCETVESLGYRAGVYFNIDYYRNWYDHALLDQYVKWLADWTGEADYPCDFHQYTSKGSVPGISGNVDMNYYFVSESNENVVEDGNAKPEVAAGVTAEQVLDVARGWLGFSEANGKFKEILDLYNSHKPLARGYAIKYTDSWCDAFVSACAIKAGAVDLIGTEVGCEKHVEIFKAMGIWNEDGSVKPEVGDVIVFNWDDSTQPNDGYSDHIGYVEQVYGDTIVCIEGNMNDQVGRRTINVGWGYIRGFAHPRYAKDNSSQIVGTAKSIDELANEVLQGAWGNGDARKAALEQAGYNYGEIQKRVNVLVKTTKGSIDAIAREVIAGKWGNGQDRKNRLIQAGYDYAAVQKRVNELA

SEQ ID NO: 1968 - protein, 322 aa, unidentified
  REGION 1..322: note = Butyrivibrio sp. M55
MNLVESIMTENPCYTEGRKITVKGLMLHSVGCAQPRAMAFINSWNTPAHDNSCVHGFIDGNDGTVYQTLPWDHRGWHAGGAANNTHIGVEMCEPASLNYISGATFTCSNRPEALKTVKRTYEAATELFAMLCRLYNLDPLEDGVIVSHNEGHIRGIASNHSDPEHLWNQLETGYTMDGFRSAVKELMDKEDAGNINDDNGKYPKTPFSVKVLIDNLNIRANPYFGNNIKGQTGRGTFTIVEVRNGWGKLKSGIGWIYLEEESYCTVLDRVVGESYEKKTIDEVAIEVINGKWGNGEERKMRLTEAGYDYNAVQKRVNELIWY

SEQ ID NO: 1969 - protein, 313 aa, unidentified
  REGION 1..313: note = Enterocloster bolteae
MSNSSLVSYTLLSPNHSGKRTHSIDRITPHCVVGQLSAASICGCFTSPDREASCNYGIGKDGQISLCVDEGNRSWCSSSNANDQRAVTIECASDKEHPYAMTDAVYQSLIKLCVDICRRNGKSKLLWFGDKDKTLAYEPKAGEMVLTVHRWFANKACPGDWLYSRLGDLAAKVTAQLGGGASTPSTDGTLYRVQAGAFKNKENADRQLEKIKAAGFDTYMVQAGGYYKIQVGAYSVKANAENMLAKVKAAGFDAFITTEQGQAVSSTPAKKSIDEIAREVIRGDWGNGQDRKNRLTAAGYDYDAVQKRVNQLV

SEQ ID NO: 1970 - protein, 269 aa, Peptoniphilus lacrimalis
MSNSPLVQARILSPNHSGRRNQKITKIAIHHAAGVINGRNLAGIFVPRSRKASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFSYIASEVNKRLRSDKTVSKKAGELYRVRKSWSDAKSQKGAFRNIENAKKCADRFGLKVFDVNGKIIYPVGKTIDQLAREVISGKWGNGDERKRRLTNAGYDYKAVQKIVNKLI

SEQ ID NO: 1971 - protein, 269 aa, Anaerococcus vaginalis
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFSYIASEVNKRLRGNNTVSKPTSGLYRVRKSLSDSKSQKGAFKNLENAKRCADRFGLKVFDANGKIVYPVGKTIDQLAKEVISGKWGNGEERKRRLTQAGYDYYVIQKRVNELI

SEQ ID NO: 1972 - protein, 269 aa, Finegoldia magna
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGNKFPYIAREVNKRLRGDNTVSKPTGGLYRVRKSWSDSKSQKGAFKNLENAKRCADRFGLKVFDVNGKMVYPVGKTIDQLAREVISGKWGNGEERKRRLTNAGYDYYAIQKRVNKLI

SEQ ID NO: 1973 - protein, 269 aa, unidentified
  REGION 1..269: note = Peptoniphilus
MSNSPLVQATILSPNHSGRRNQMITKIAIHHAAGVINGRNLAGIFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFLYIASEVNKRLRGDKTVSKPTSGLYRVRKSWDDPKSQKGAFKNLENTKRCADRFGLKAFDANGKIVYPVGKTIDELAKEVISGKWGNGEERKRKLTNAGYDYKEVQKRVNELI

SEQ ID NO: 1974 - protein, 269 aa, Anaerococcus vaginalis
MSNSPLVQARILSPNHSGRRNQKITKIAIHHAAGVINGRNLAGIFVPRSRRASSNYNLGSDGIIVLGVDESNRAWTTSSSWCDNRAVTIEVGNSTRGPQWLVSDYVLNRLIDLVTDICKRNGIYPCTYTGGKDGVLQKHEWYKNTNCPGPYLGSKFPYIANEVNKRLRGNNTVSKPVGGLYRVRKSWSDVNSQKGAFKSLENAKRCADRSRLKVFDANGKIVYPVGKTIEELAKEVISGMWGNGEERKRRLINAGYDYRAVQKRVNQLV

SEQ ID NO: 1975 - protein, 269 aa, unidentified
  REGION 1..269: note = Peptoniphilus grossensis
MSNSPLVQARILSPNHSGRRNQKITKIAIHHAAGVINGRNLAGIFVPRSRKASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFSYIASEVNKRLRGNNTVSKPTSGLYRVRKSWSDVKSQKGAFKNLENAKRCADRFGLKVFDANGKIVYPVGKTIDQLAKEVIRGDWGNGEERKTKLTNAGYDYYAVQKRVNKLI

SEQ ID NO: 1976 - protein, 307 aa, unidentified
  REGION 1..307: note = Candidatus Mediterraneibacter intestinipullorum
MGVLRVIDASSHQGSMDQAAMDFDALIVKATEGTSYVNPYCDGEFQKALELGKKLGVYHFARNASGNSAQAEADFFIQNTQNYIGKAIPVLDWEDTDTSNVTWALEWLQRVEKAYGCKPLIYMSESVVNCYDWSAAAAGGYGLWCAKYADYIPDYNWDMAGAGPAPSVKWWPVAALWQWTSVGRLDGHEGNLDCSVFYGDRKAWDQYVGGMETVQSVPPAFGRALPEQSTLELAEAVMKGVYGNGDERRTALGSRYGEVQDMIDHVASASVDTLVNETLAGKYGNGETRKIVLGARYAAVQERINNQ

SEQ ID NO: 1977 - protein, 178 aa, unidentified
  REGION 1..178: note = Bacteroidaceae bacterium
MRNERNVQLFTNKDFEKMGKEPAKKKSWLWVLLLLIVAAIVALICLHTCDKERTTPHTPIVNTVEAVINSPVATEAETVAGAAAETSSLAAEQSGTSAAATSDNAASSLESGRTVASGAAKPVADTGRRGDVDVLLMAKRVIRGDYGNGDERKMALKDNYQAIQNQVNLNYSKGDLYW

SEQ ID NO: 1978 - protein, 249 aa, unidentified
  REGION 1..249: note = Eggerthellaceae bacterium
MVQIRKKVTLKTKTEQEPVLEEAQAAKVQPTLHKKTPEKEPEQQCGQQPEQVTDGNESNDKGGKNKILWALAILVVVLLLLLLCCGAYYLLFSNRSGNDVAAEQVEQGAYAPSNDDEAKAENNEGAEANPESESVLGDIVANNEEKAHAVQNEAKPESPTHQAVQTQPAPVKEDVVAPELAPAPNKSVSQVDKPGAAQSVVPSGTLEQKAKDVIRGIYGNGNVRKQKLGEQYAEIQSKVNEMYRQGLVE

SEQ ID NO: 1979 - protein, 239 aa, unidentified
  REGION 1..239: note = bacterium
MGEKRNRRNFDFSKSIDNRFDFTKDEPDIVENPQQPKDINTPDEPTKKPIRCSNTGRIVGGIAAATAILAGVYFFGIKGDDSIEDNAGATTEQMAQACETAKPDNAQPADAVEDVSPGEKTAVVDEAEASTSANETPPAGDDSNATTPAKADGKHAGKPSTNDTPADNPVQSTQPEHSHSVTAKASNTSTPVSGDVVENARRVIRGDFGNGQERKDKLGSAYAEIQSKVNEMYRQGLVD

SEQ ID NO: 1980 - protein, 248 aa, unidentified
  REGION 1..248: note = Muribaculaceae bacterium
MAKNRNFDLNKGGDNKFDLHKGPNRKFDLQKDMDDEDEVAVAAEEAASTEEPRPVIPPAQTPQPEEPASVLEPEVTPQRVADAIEYGPEEPKKKGFAWLWALIGIAIVLAVLGMIFLRDGNKEEQAEEPVETVAEGMPGDSAVSDEAEAPTPEAENNAEAAPAAATAESTPVAAPAAPTASEPVAAAPATPKASAVDLSAQPTGSVKEEAKNVIKGIYGDGSERKNRLGDRYKEIQRRVNKMKRSGKF

SEQ ID NO: 1981 - protein, 196 aa, Tannerella sp.
MAELKRKVTLKRKDSSTGDTPLPPKKSNWWIWLALALVVIVVVFFLIRNCTSSGYKPAPDEPPVIEQAAPAEQPSETAEPTSTGESETTPDGQTPAPSQSEQAGQGAQTPAANQGGQGAQAPAANQAPSSSQGAQTPAANRPSASTPSQRSVDNVTDKAKEVIQGRYGNGEARKQALGSEYGEIQRKVNEIYRKGY

SEQ ID NO: 1982 - protein, 201 aa, unidentified
  REGION 1..201: note = Firmicutes bacterium ADurb.Bin099
MTTNNKGIALIKSFEGLRLKAYKALPSEKYFTIGYGHYGADVKEGQTITDAEAEALLRSDLKKYEAKVNKYSAYNWNDNEFSALVSFAYNIGNIDDLTKKGERSREEIKKVWTSYSKAGGKEVPGLLRRRKAELELFNTGDTMAEELTKDPKDSKEVKLNHLIELTRATMRGEYGSGPNRRNKLGSAYNAVQSIINYIYLS

SEQ ID NO: 1983 - protein, 242 aa, Prevotella intermedia
MVSIKHKVTIKTKTAQEETPAAVESPAVTLKRKQPEVANEPTKVAPVPETPKKSNKGKIIGGVAAAAAILAGVYFFGIKGDDKTGDDVTPPTEQIAQARDATQPEPTTQTDVPEEGTAEESGAASDAPETVSPAEASDALAKTGTDQTQTPTQPTEQKADKPSSVASSFTKPVQQAQSPKNNATTSQIAAASAPIGGDVAENAKRVIRGDFGNGQERKDKLGSAYVEIQSKVNEMYRQGLVY

SEQ ID NO: 1984 - protein, 242 aa, Prevotella intermedia
MVSIKHKVTIKTKTAQEDTPAAVESPAVTLKRKQPEVANEPTKVAPVPETPKKSNKGKIIGGVAAAAAILAGVYFFGIKGDDKTGDDVTPPTEQIAQARDATQPEATTQTDVPEEGTAEESGAASDAPETVSPAEASDAPAKTGTDQTQTPTQPTEQKADKPSSVASSSTKPVQQAQSPKNNATTSQIAAASAPIGGDVAENAKRVIRGDFGNGQERKDKLGSAYAEIQSKVNEMYRQGLVY

SEQ ID NO: 1985 - protein, 246 aa, unidentified
  REGION 1..246: note = Leyella stercorea
MKTKVAQEETPEAIESPKVTLKRKQPETPVVAEPKPTPTQPKTEQKPQTVSPTPQPEKKSNTGKVIGGLVAAAIIAGIFFFINNKESEGGKDSTQTEVIAQNTENQNEGYDAPAAENSNEDASAESNGVPANGSEAPGAENTDKSPANTTSSAKPAKANDNQVAEQPTKQNPATIAEPAQSKPASTETTKPSPSTSAPVSGDVEENARRVIRGDFGNGQERKDKLGSSYSEIQGKVNEMYRQGLVH

SEQ ID NO: 1986 - protein, 354 aa, unidentified
  REGION 1..354: note = uncultured Enorma sp.
MALNGIDISNYQRGLDLAQVPCDFVICKATEGTTIVHNTCDPWIQQAIKLGKLWGFYHFMNGEDPIAQAKHFVASCRNYFGNGVPVLDYEMYGRIGTDKAKQFLDYVYDQTGVRCIVYMSRSVCTEEDWSKIAPNHALWVAQYANNNRTGYQSSPWLPDGGFGAWGSCAIHQYTSNGRLDGFNAPLDLDIAYMTREAWGKFANPSGSATPDVPPAEVADPSPEGTTLELAAAVMRGEYGVDDERREKLGDRYQEVQDLINYIDGASASQLADDVERGMFGVVPTRSDVLGDRFSEVQAIVNQRAGVGTARVYTVKSGDTLSEIGASLGIDWHTIASKNGIGAPYTIYPGQKLSY

SEQ ID NO: 1987 - protein, 262 aa, Prevotella sp.
MVSIKHKVTLKTKVAQEETPEAIESPKVTLKRKQPEASVVAEPKPAHAPTQPTAEPKQEPKPVSPTPQPEKKSNTGKVIGGLIVAAIIAGIFFFINNKESEGGNDSTPTEAIAQNTENQDKSNDAPAAENSNEDASAESNGVPANGSEAPVAENTDKSPANTTSLANHAKVNDNQVAEQPTKQNPTIIAESAKPTQSKPAATQPTRSSSATSASVSGDVEENARRVIRGDFGNGQERKDKLGSSYSEIQGKVNEMYRQGLVH

SEQ ID NO: 1988 - protein, 513 aa, unidentified
  REGION 1..513: note = uncultured bacterium IN-06
MKLVESILTKNPCYTAGRTITVKGLMLHSVGCSQPSALAFIKNWNSPSFERACVHGFIDGNDGTVYQTLPWNHRGWHSGSSINGSANNTHIGVEMCEPACITYVGGATFKCSDIATAKAVVERTYKAAVELFAMLCKQYGLNPLADGVIISHKEGHSRGIASNHGDPEHLWSQLGMGYTMDTFRKAVKSAMGDSENKKEGTQASVFAGLSEKDAVSVIGELCREDMKKSGILASISAAQFILESGYGKSELGQNANNMFGMKKSLSGNTWAGSTWDGTSVYTKKTKEQHTDGTYETITADFRKYTCVEDSVADHSAYLLGAKNGKALRYKGIKGITDYRAVAQLIKDGGYATSLSYVDNLCNIIEKWNLTQYDTDSQTIPDDTPSNPDTVTSFPATPFSVKVIIDDLNYRSEPSMKGKVNGQTGKGTFTIMEVQNGGWGRLKSGAGWIWLSNPTYCTVGKTVKITEDKKKSIDELAKEVIRGDWGNGTERKEKLTAAGYDYAAIQKRVNEMLK

SEQ ID NO: 1989 - protein, 320 aa, unidentified
  REGION 1..320: note = Ruminococcaceae bacterium CPB6
MAIKGIDVSHWQGNIDWSKVKAAGIQFAIIKAGGSDDGFYTDSKWEANYKGAKANGIAVGAYYFVGPKCVNAAAGKADAERFIQLLKGKQLEYPVFMDNEAQPASAKAGITEATIAFCETMEAAGYFVGIYGSTDSGFHERMDDSRLTAYTHWVAQYASKCTYSGSYGIWQHSSSGRVNGISGNVDMDLSYVDYPSAIKNGGFNGYAKGTATGNTPAAPAKKSVDEIASEVIAGKWGNGDDRRNRLTTAGYNYSAVQSKVNEKLGATAEQSAVYYTVKRGDTLSAIASKYGTSVSAIQKLNSSLIKNVNLIQVGWRIRVK

SEQ ID NO: 1990 - protein, 312 aa, unidentified
  REGION 1..312: note = Caudoviricetes sp.
MKNYGLDLSEHNGKVDFKALKNACNEYVILRCGYGSASSQKDKRFEEYYKQAKSVGLNVGAYLYGYALNTTQALEEAKRCCEWLKGKQFDMPVYYDMEDADGYKKRNGMPSNATLSAICETFCNYMEKQGYYVGIYASESWFNNQLKNVVSKNKYDLWVANWGSNNGTLQSDKSNSYRLHQFTSMYSLTGKRLDRNVLYYDYPTLLKNRGFNGYNSETKPTKKTIEEIANEVIQGKWGNGAERVNKLKKAGYDANAVQNKVNEKLGVKTKSIEALAKEVIQGKWGNNPERKERLTKAGYDYNAVQKRVNEIL

SEQ ID NO: 1991 - protein, 288 aa, unidentified
  REGION 1..288: note = Caudoviricetes sp.
MKIKGVDLSYCQEGISFPALKKAGVKFAIIRAGFSTKKDVTMDRFVADCKKYGIEYGFYWYSYAISIEQAQTEAEKCISVIKGLSPTYPVYFDMEEKKQISGLSTDTRTKMAIAFCEKIRQAGFKPGVYANPSFMENYYDKSRIVGRYDIWLAHWTNSPERPSRYDYGQTMWQWGLDRIGGYDVDGDICFTDYWKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 1992 - protein, 245 aa, unidentified
  REGION 1..245: note = Caudoviricetes sp.
MSMPKVFLSPSNQYDNRYAYGDTTEGVQCGKIAEACKAALERSGVTVKLMHDESMQEKCAASNAFGADLHVPIHTNAFNGTVTGTRMFCFSSSGEGMKACQAIFNRLAPITPGTSENIRVDASLYEVRVPSAATAYIECEFHDSVESAEWIINHTGYIGETIARGICDYFGVTFREKEQAQPAKSVDEVAREVIRGEWGNGSDRRQRLEAAGYDYDAVQNHVNAILTGDEPEQPAEPTPAEPVEP

SEQ ID NO: 1993 - protein, 291 aa, unidentified
  REGION 1..291: note = Caudoviricetes sp.
MKGATAMPKVFLSPSNQYDNRYAYGDTTEGVQCGKIAEACKTALERSGVTVKLMHDESMQEKCAASNAFGADLHVPIHTNAFNGTVSGTRMFYYAEGGEGQKACKAIFARLAPVTPGTSESIRADASLYEVRVPAAPTAYVECEFHDNPEAAKWIVENTGLIGETIARGICDYFGVTFREKEQAAPTKSVDEVAREVIRGEWGNGSDRRQRLEAAGYDYDTVQDRVNAILTGDAPEQPAPAKPTEPVPEPEQPATDKLYRVQVGAFAVRENAEKMLRRLKDAGFEGYIREG

SEQ ID NO: 1994 - protein, 289 aa, unidentified
  REGION 1..289: note = Caudoviricetes sp.
MKIKGVDLSYCQEGISFPALKQAGVRFAIIRAGFSTKKDVTMDKFVADCKIHGIEYGFYWYSYAMSVEQAQTEAEKCIEVIKNLSPTYPVYFDMEEKKQVSGLSTDTRTKMAIAFCEKISQAGFKPGVYANPSFMENYYDKNRIIGKYDIWLAHWTNSPNCPSKYSYGQTMWQWGLDRIDGYDVDGDICFFDYAKSAHEKKTVDELADEVIAGKWDNGAERERLLTAAGYDYNAIQKRVNEKLYRKTTDEIAVEVIAGLWGNGAERKEKLTEAGYDYSEVQKRVNEMLR

SEQ ID NO: 1995 - protein, 288 aa, unidentified
  REGION 1..288: note = Caudoviricetes sp.
MKIKGVDLSYCQEGISFPALKQAGVKFAIIRAGFSTKKDVTMDKFVADCKKHSIDYGFYWYSYAMSVEQALTEAEKCIEVIKNLSPTYPVFFDMEEKKQISGLNTDTRTKMAIAFCEKISQAGFKPGIYANPSFMENYYDKSKIVGRYDIWLAHWTNSPDCPSKYNYCQTMWQWGLDRIGGYDVDGDICFTDYGKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 1996 - protein, 511 aa, unidentified
  REGION 1..511: note = Caudoviricetes sp.
MKLVESILTKNPCYTAGRKIEVKGLMLHSVGCSQPSALAFIKNWNSPSFDRACVHGFIDGNDGTVYQTLPWNHRGWHCGSSINGSANNTHIGVEMCEPSCITYVGGATFKCSDIATAKAVAERTYEAAVELFAMLCKKFSLDPLADGVIISHKEGHSRGIASNHGDPEHLWSQLGMGYTMDTFRKAVKSAMSDSENKKEGTQAAVFAGLSEKDAVSVIGELCREDMKKSGILASISAAQFILESGYGKSELGQNANNMFGMKKSLSGNTWTGSTWDGTSVYTKKTQEQNADGSYETITADFRKYSCVEDSVADHSAYLLGAKNGRSLRYKGIKGMTDYKAVAQIIKDGGYATSLTYVEKLCNIIEKWNLTQYDVTDAPAPKPSTPDTVTEFPATPFSVKVIIDDLNYRSEPSMNGKVNGQTGKGTFTIMEVRNGGWGRLKSGAGWIWLSNPTYCTVGKTVKITEDKKKSIDELAKEVIRGDWGNGTERKEKLTAAGYDYAAIQKRVNEMLK

SEQ ID NO: 1997 - protein, 276 aa, unidentified
  REGION 1..276: note = Caudoviricetes sp.
MSMSNSSLVSYTKLSPNCDHPRTHAIDKITIHHMAGDLSVETCGNLFAKPSYEASSNYGIGSDGRVGLYVDEGDRAWASASPSNDNRAVNIEVANCATGGDWPVSSAAYNKLIDLCVDICQRNGIKALNYTGDTDGNLTEHRMFVATACPGPYLHERMGRIAAEVNSRLSAQPAKSVDEVAREVIRGEWGNGSDRRQRLEAAGYDYDAVQNHVNAILTGDEPEQPAPAEPVEPAPEQPATDKLYRVQVGAFANRENAEKMLRRLKDAGFEGYIREV

SEQ ID NO: 1998 - protein, 289 aa, unidentified
  REGION 1..289: note = Caudoviricetes sp.
MKIKGIDLSYCQEGISFPALKQAGVKFAIIRAGFSTKKDVTMDKFVADCKKYGIDYGFYWYSYAMSVEQAEAEAEKCISVIKELSPTYPVFFDMEEKKQISGLNTDTRTKMTVAFCEKIRQAGFMPGIYANPSFMENYYNKNRIVGKYDIWLAHWTNSPDCPSGFSYGQTMWQWGLDRIGGYDVDGDICFTDYSKKKPVKKTIDQLADEVLAGKWDNGAEREKQLTAAGYDYNAVQKRVNEKLYRKTTDEIAVEVIAGLWGNGAERKEKLTEAGYDYSKVQRKVNQMIK

SEQ ID NO: 1999 - protein, 236 aa, unidentified
  REGION 1..236: note = Caudoviricetes sp.
MAKVFLSPSNQYDNRYAYGDTTEGVQCGKIAEACKAALERSGVTVKLMHDESMQEKCAASNAFGADLHVPIHTNAFNGTVSGTRMFCFNSNGEGMRACQAIFARLAPVTPGTSESIRADASLYEVRVPAAPTAYIECEFHDNPTASKWIVEHTGDIGETIARGICDYFGVTYKEKEQPKPAKSVDEVAREVIRGEWGNGSDRRQRLEAAGYDYDTVQNRVNAILTGDEPEQPAEPT

SEQ ID NO: 2000 - protein, 289 aa, unidentified
  REGION 1..289: note = Caudoviricetes sp.
MMKINGVDLSYCQEGISFPALKQAGVRFAIIRAGFSTKKDVTMDKFVADCKKHSIDYGFYWYSYAMSVEQALTEAEKCIEVIKNLSPTYPVFFDMEEKKQISGLNTDTRTKMAIAFCEKIRQAGFKPGVYANPSFMENYYDKSRIVGRYDIWLAHWTNSPNCPSKYNYGQTMWQWGLDRIDGYDVDGDICFTDYGKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 2001 - protein, 289 aa, unidentified
  REGION 1..289: note = Caudoviricetes sp.
MMKIKGVDLSYCQEGISFPALKQAGVRFAIIRAGFSTKKDVTMDKFVADCKKHSIDYGFYWYSYAMSVEQALTEAEKCIEVIKNLSPTYPVFFDMEEKKQISGLSTDTRTKMAIAFCEKIRQAGFKPGVYANPSFMENYYDKSRIVGRYDIWLAHWTNTPTCPSKYNYGQTMWQWGLDRIDGYDVDGDICFTDYGKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 2002 - protein, 276 aa, unidentified
  REGION 1..276: note = Caudoviricetes sp.
MSMSNSSLVSYTKLSPNCDHPRPHAIDKITIHHMAGDLSVETCGNLFANSSYEASSNYGIGSDGRVGLYVDEGDRAWASASPSNDNRAVNIEVANCATGGDWPVSSAAYNKLIDLCVDICQRNGIKALNYTGDTDGNLTEHRMFVATACPGPYLHERMGRIAAEVNSRLSAQPAKSVDEVAREVIRGEWGNGSDRRQRLEAAGYDYNAVQDRVNAILPGDAPEQPTPAEPVEPAPEQPATDKLYRVQVGAFAVRENAEKMLQRLKDAGFEGYIREA

SEQ ID NO: 2003 - protein, 289 aa, unidentified
  REGION 1..289: note = Caudoviricetes sp.
MKIKGVDLSYCQEGISFPALKQAGVKFAIIRSGFSTKEDVTMGKFVADCKKYGIDYGFYWYSYAMSVEQAETEAEKCISVIKGLSPTYPVFFDMEEKKQISGLSTDTRTKMAIAFCEKIRRAGFKPGVYANPSFMENYYDKSRIVGRYDIWLAHWTNSPDCLSKYNYGQTLWQWGLDRIDGYDVDGDICFFDYAKSAPEKKTVDELADEVIAGKWDNGAERERLLTAAGYDYNAVQKKVNEKLYRKTTDEIAVEVIAGLWGNGSARKEKLTEAGYDYSEVQKRVNEMLG

SEQ ID NO: 2004 - protein, 285 aa, unidentified
  REGION 1..285: note = Caudoviricetes sp.
MPKVFLSPSNQYDNRYAYGDTTEGVQCGKIAEACKAALERSGVTVKLMHDESMQEKCQASNAFGADLHVPIHTNAFNGTVTGTRMFYYAEGGEGQKACKAIFARLAPVTPGTSESIRADASLYEVRVPAAPTAYIECEFHDNPTASKWIVENTGLIGETIAQGICDYFGVNFKGKEQAAPAKSVDEVAREVIRGEWGNGSDRRQRLEAAGYDYDTVQDRVNAILTGDEPEQPTPAEPVEPAPEPEQPATNKLYRVQVGAFAVRENAEKMLKRLTDAGFAGYIRAD

SEQ ID NO: 2005 - protein, 426 aa, unidentified
  REGION 1..426: note = Caudoviricetes sp.
MDPVTKQEFISAVAGYVQKYAAQYGILVHSSVIAQAILESGWGQSSLAAVYHNYFGLKCGSKWTGPSVNLATKEEYQPGQLTAIRDNFRVYSSMEEGVMGYFEFIQLARYENLKGITDPLRYLETIKADGYATSSAYVQNLMNIIEQYNLTEYDNEGSVNVSKVEKAIQQMEAWATDDSHGYDQKWRWGEKGDFDCSAAVIQAWESAGVPVKTNGATYTGNMLGVFKKTGFKDVTSQINLATGAGLIRGDVLLNSGHHAAMYCGNGKEVEASINENGTITGGTPGDQTGKEFLIRAYRNYPWTNVLRYAETTAGGKSIDEVAQEVIKGNWGNGNARREALAAAGYDYAAVQARVNEILTGKASTPDPEPEPAPAPEPTPAPVEPQTSGSWIDAAAREVIAGKWGNGQDRKERLYSAIQARVNELLR

SEQ ID NO: 2006 - protein, 567 aa, unidentified
  REGION 1..567: note = Caudoviricetes sp.
MAMKGIDISNWQGNVDFNKVKADGIQFCIFREGYRRAIDGQFKNYVKGAKAAGIPILGVYHFIYVDGATPKQNAEACIANMKAAGLDPASTWIFSDLEYDTWTKAGIKVTKALCTQYTIEFLSTLKAVGCKKLGIYCNLDYYRNYYDWNQLGEYREYLWLADYTGGPDVDCAIQQTGSTGKVSGISGNVDMDTLFDESMLSGKEETKVGVTAQDVLNVMRSWIGYSEANGRYLEILNIYNSHKPLARGYAIKPSDEWCDATVSAAAIKVGAVDLIGTEVGVEKHVDIFKKKGIWIEDGSIKPQAGDIIVFNWDDSSQPNDGYSDHIGYVEQVSGNTITCIEGNMSEKVGRRTINVGWGYIRGFARPKYASGGVAPTPNPDKSINEVAQEVIQGAWGNGDARKQALTAAGYDYGAVQAEVNRILGGGSSSLKSVNEVAKEVIAGKWGNGDARKQALTNAGYNYNAVQAEVNRILGGTGSKSVTTLAQEVIQGKWGNGNERKQKLESAGYNYAAVQAKVNELLGSGKSIDELAREVIQGKWGNGNERKQKLTQAGYDYDKVQARVNQLL

SEQ ID NO: 2007 - protein, 285 aa, unidentified
  REGION 1..285: note = Caudoviricetes sp.
MAKVFLSPSNQYDNRYAYGDTTEGVQCGKIAEACKAALERSGVTVKLMHDESMQEKCAASNAFGADLHVPIHTNAFNGTVSGTRMFYYAEGGEGQKACKAIFARLAPVTPGTSESIRADASLYEVRVPSAPTAYIECEFHDNPTASKWIVENTGLIGETIARGICDYFGVTFREKEQAQPAKSVDEVAREVIRGEWGNGSDRRQRLEAAGYDYNAVQDRVNAILTGDAPEQPTPAEPVEPSPEPEQPATDKLYRVQVGAFAVRENAEKMLQRLKGAGFEGYIREG

SEQ ID NO: 2008 - protein, 314 aa, unidentified
  REGION 1..314: note = Caudoviricetes sp.
MKKYGLDLSTHNGGLDFQAIKNAGNEFVILRCGYGSASSQKDTHFEEYYKQAKSVGLHVGAYLYSYALDTVGALAEAKMCCKWLKGKQFDMPIYYDMEDADGYKKKHGMPSNATLSAICETFCDYMEKQGYYVGIYASESWLKNQLASVVSKDEYDLWCANWGTNDGTLQSDKSNNYPLHQFTSMYSLSGKRFDRNVLYYDYPRLLKERGFNGYKDGTVTEPTKKTIEELAKEVIQGKWGNGAERVRRLIQAGYDANAVQNKVNEKLGVKVKNIDTLAKEVIQGKWGNGQDRKNRLTQAGYDYNAVQKRVNEML

SEQ ID NO: 2009 - protein, 50 aa, unidentified
  REGION 1..50: note = Bacteriophage sp.
MNEILNKKTVDEIANEVIRGEWGNGAERKEKLTAAGYDYFAVQKRVNEML

SEQ ID NO: 2010 - protein, 287 aa, unidentified
  REGION 1..287: note = Caudoviricetes sp.
MVEKINETLMSDSGRLVNLEFVVIHNDAGSMTPKQYIDWLRYRDKALGIAHYYCNRDCIARVVDTFNIGYHTGDWWSNCRSIGYEVCESMKVSNTEFLQNEDVTLMQATEDLLFYGLPITTQTVRLHHEFVPTTCPHRSMELHGGSTESVKKYFVDRMNYFATLGSTVEEMMGQYNGEVTVEKVTSKENTLKSDETVANEVLQGLWGNGNDRFELLTNAGYDAQKIQNIVNRLVLGEYDEEVVDIDEVAREVIQGEWGNGDERKARLENAGYDYQVVQDRVNELLGE

SEQ ID NO: 2011 - protein, 325 aa, unidentified
  REGION 1..325: note = Caudoviricetes sp.
MSNSSLVNMTMLSPNHSGHRNQPITKIAIHHTAGAISAATIGQIFRPTSRQASCNYGIGNDNKIVLCVDEANRSWCTSSSWCDNRAVTIEVANSANGGNWPVSDRTLATLIDLVTDICRRNGIRNCTYTGGKDGVLQKHEWYANTNCPGPYLGSKFSYIASEVNKRLSGNSSSSGGASTSSLYRVRKSWSDAKSQKGAFRDFDNAKKCANANAGYKVFDASGNEVYPNKVTSSKSVDTLAHEVLAGNWGNGSDRANRLRAAGYDYDAVQNRVNEILSGSSKTKSIDTIAREVIRGDWGNGQDRANRLRAAGYDYNAVQKRVNEIL

SEQ ID NO: 2012 - protein, 288 aa, unidentified
  REGION 1..288: note = Caudoviricetes sp.
MKIKGVDLSYCQEGISFPALKQAGVRFAIIRAGFSTKKDVTMDKFVADCKKHSIDYGFYWYSYAMSVEQALTEAEKCIEVIKNLSPTYPVFFDMEEKKQISGLNTDTRTKMAIAFCEKISQAGFKPGIYANPSFMENYYDKSKIVGRYDIWLAHWTNSPDCPSKYNYCQTMWQWGLDRIGGYDVDGDICFTDYGKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 2013 - protein, 299 aa, unidentified
  REGION 1..299: note = Caudoviricetes sp.
MDKQTFISQIAAYVIKYAAQYGIKVHSPIIAQAILESGWGQSSLAAKYHNYFGLKCGSAWTGKSVNMATSEEYTPGVHTNIRDNFRVFDSMEDGVKGYFDFINYSRYANLKGVTDPQTYVENIKADGYATSSTYVTNLMRVIRDNNLTQYDGAAQQTPSKSVDEVAQDVVNGKYGNGADRKAALEVAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNDLM

SEQ ID NO: 2014 - protein, 387 aa, unidentified
  REGION 1..387: note = Caudoviricetes sp.
MAYTNSPLVSYTKLSPNNSGQRNHSIDTITIHCVVGQCTVQTLGEVFAPVSRQASSNYGVGLDGKIGMYVEEKNRSWCTSSPSNDHRAITIEVASDTKEPYAVKDVAYNATIQLVADICKRNGIKKLVWSTDKNVRMNHLNGCNMTVHRDYANKSCPGTYLYERMGDIATKVNAILGESESTSSSTSSTETSFKFKVGDIVNFAGGTHYTNANATSGSSVKASKAKITQTYNGKHPYHCRAVNDAGNFISGVYGWVDADTLSAISSTPASKSEPKVGDIVNFTGSVHYTNANASTGPSAKPGKAKITAISKGGKHPYHVVHVDSSSNVYGWVDANTISVSTSTGKSIDELAKEVIQGDWGNGQDRKNRLTAAGYDYNAVQKRVNELL

SEQ ID NO: 2015 - protein, 288 aa, unidentified
  REGION 1..288: note = Caudoviricetes sp.
MRIKGVDLSYCQEGISFPALKQAGVKFAIIRAGFSTKKDVTMDKFVADCKKHSIDYGFYWYSYAMSVEQALTEAEKCIEVIKNLSPTYPVFFDMEEKKQISGLNTDTRTKMAIAFCEKISQAGFKPGIYANPSFMENYYDKSKIVGRYDIWLAHWTNSPDCPSKYNYCQTMWQWGLDRIGGYDVDGDICFTDYGKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 2016 - protein, 289 aa, unidentified
  REGION 1..289: note = Caudoviricetes sp.
MKIKGVDLSYCQEGISFPALKEAGVKFAIIRAGFSTKKDVTMGKFVADCKKYGIDYGFYWYSYAMSIKQAQAEAEKCVEVIKGLSPTYPVFFDMEEKKQISGLNTDTRTKMAIVFCEKIRQAGFKPGVYANPSFMENYYDKSRIVGRYDIWLAHWTNSPNCQSKYNYGQTMWQWGLDRIGGYDIDGDICFTDYSKKKTVEKTIDQLADEVLAGKWDNGAERERLLTAAGYDYNAVQKKVNEKLYRKTTDEIAVEVIAGLWGNGSARKEKLTEAGYDYSEVQKRVNEMLG

SEQ ID NO: 2017 - protein, 285 aa, unidentified
  REGION 1..285: note = Streptococcus ictaluri 707-05
MVEKINVNLMNVGRLASIDFVVIHNDAGSMTPEQYINWLRNRNKELGIAHYYINRHTIARVIDTYNIGYHTGEWHSNTHSIGYEVCEGLKVGDKEFLENEDMTLMQATEDLLFYGLPINHQTVRLHHEFTPTTCPHRSLALHGGTTQSVKDYFVSRMKYFATLGKTVDEMLAKKGAPTSTPKPTIQPSSSKKSIDEVAREVLNGKWGNGAERKSALESAGYSYSQVQQRVNDLIYGTIPQTKSVDEVAKEVINGQWGNGQDRRNRLMGAGYNYDEIQRRVNELLG

SEQ ID NO: 2018 - protein, 63 aa, unidentified
  REGION 1..63: note = Gardnerella vaginalis 0288E
YDYASVQNKVNELLGVKACRKSVDELAREVIRGAWGNGSTRKQRLTSAGYDYDTVQKRVNELL

SEQ ID NO: 2019 - protein, 93 aa, unidentified
  REGION 1..93: note = Gardnerella vaginalis JCP8108
TSSIDEVAREVINGAWGNGNERKQRLTSAGYDYASVQNKVNELLGVKAYRKSVDELAREVIRGAWGNGSTRKQRLAQAGYDYDTVQKRVNELL

SEQ ID NO: 2020 - protein, 312 aa, Listeria innocua
MKTKGIDISTWQKPSQINYDQLAKEVDFVILRAGYTGHGTGVSLHKDDAFEQHYKAFHERGIPIGVYWYSCANTNAKGVAEAKKCLEIIKGKTISYPVFIDTEDNYHQRPSGKKAITDALVGFCETVENAGYYAGIYASSSWFQDLTELDRLAPYDFWVAQWSNKEPTLRHGIWQYTSKGKLSGYSGNLDMNYAYKDYKAIIQSAGLNHLGKEESVPAPTEKKSVETLAKEVIQGLWSNGEERKKRLTDAGYDYAAVQSKVNEMLSSKKSIDAIAKEVIRGDWGNGQERKNKLTKAGYDYVSVQKRVNELLK

SEQ ID NO: 2021 - protein, 312 aa, Listeria monocytogenes
MKTKGIDISTWQKPSQINYDQLAKEVDFVILRAGYTGHGTGVSLHKDDAFEKHYKAFHERGIPIGVYWYSCANTKTKGIAEAKKCLEIIKGKTISYPVFIDTEDNYHQRPSGKKAITDALVGFCETVENAGYYAGIYASSSWFQDLTELDRLAPYDFWVAQWSNKEPTLRHGIWQYTSKGKLSGYSGNLDMNYAYKDYKAIIQSAGLNHLGKEESVPAPTEKKSVETLAKEVIQGLWSNGEERKKRLTDAGYDYAAVQSKVNEMLSSKKSIDAIAKEVIRGDWGNGQERKNKLTKAGYDYVSVQKRVNELLK

SEQ ID NO: 2022 - protein, 312 aa, Listeria innocua
MKTKGIDISTWQKPSQINYDQLAKEVDFVILRAGYTGHGTGVSLHKDDAFEQHYKAFHERGIPIGVYWYSCANTKTKGIAEAKKCLEIIKGKTISYPVFIDTEDNYHQRPSGKKAISDALVGFCETVESAGYYAGIYASSSWFQDLTELDRLEPYDFWVAQWSSKEPTLRHGIWQYTSKGKLSGYSGNLDMNYAYKDYKAIIQSAGLNHLGKEENIPAPTEKKSIETLAKEVIQGLWGNGEERKKRLTDTGYDYAAVQSKVNEMLSSKKSIDAIAKEVIRGDWGNGQERKNKLTKAGYDYVSVQKRVNELLK

SEQ ID NO: 2023 - protein, 312 aa, Listeria monocytogenes
MSTKGIDISTWQKPSQINYDQLAKEVDFVILRAGYTGHGTGVSLHKDDAFEQHYKAFHERGIPVGVYWYSCANTKTKGVAEAKKCLEIIKGKSISYPVFIDTEDNYHQRPSGKKAITDALVGFCETVENAGYYAGIYASSSWFQDLTELDRLAPYDFWVAQWSNKEPTLRHGIWQYSSKGKLSGYSGNLDMNYAYKDYKAIIQSAGLNHLGKEESVPAPTEKKSVETLAKEVIQGLWSNGEERKKRLTDAGYDYAAVQSKVNEMLSSKKSIDAIAKEVIRGDWGNGQERKNKLTKAGYDYVSVQKRVNELLK

SEQ ID NO: 2024 - protein, 312 aa, Listeria monocytogenes
MSTKGIDISTWQKPSQINYDQLAKEVDFVILRAGYTGHGTGVSLHKDDAFEQHYKAFHERGIPVGVYWYSCANTKTKGVAEAKKCLEIIKGKSISYPVFIDTEDNYHQRPSGKKAITDALVGFCETVENAGYYAGIYASSSWFQDLTELDRIAPYDFWVAQWSNKEPTLRHGIWQYSSKGKLSGYSGNLDMNYAYKDYKAIIQSAGLNHLGKEESVPAPTEKKSVETLAKEVIQGLWSNGEERKKRLTDAGYDYAAVQSKVNEMLSSKKSIDAIAKEVIRGDWGNGQERKNKLTKAGYDYVSVQKRVNELLK

SEQ ID NO: 2025 - protein, 269 aa, unidentified
  REGION 1..269: note = Candidatus Merdenecus merdavium
MSNSPLVQERILSPNHSGRRNQKITKIAIHHAAGVINGRNLAGIFVPRSRQASANYNLGSDGVIVLGVDESNRAWTTSSSWCDNRAVTIEVGNSTRGPKWLVSDYVLNRLIDLVTDICRRNGIYPCTYTGGKDGVLQKHEWYSNTNCPGPYLGSKFPYIAREVNKRLRGNNTISKPTSELYRVRKSWDDPKSQKGAFRNFDNAKRCADRFGMRVFDANGKIVYPVGKTIDQLAREVISGKWGNGEERKRRLTNAGYDYYAIQKRVNQLL

SEQ ID NO: 2026 - protein, 258 aa, unidentified
  REGION 1..258: note = Candidatus Dwaynia gallinarum
MIKKGIDVSVWDGNIDFNAVKANGIDFVIIRAGYGSHSSGIDKLFEQNYYRAKKANLNVGAYWYSYAKSTKDALLEANTCMNAIKGKQFDYPIYLDVEEPYFFTNGKEFCDSIITTFCNELEKYKYFTGFYMSLDYLKEYVSPTVSSRYSVWVADYANKLNYNGPYGIWQYTSNGSVNGIQNNCDLDYGYVDFPSIIMKGGFNGYLSSNNTPPSSDIDSIAREVIDGKWGNGEERKKRLTAAGYNYNEVQKRVNELLQ

SEQ ID NO: 2027 - protein, 245 aa, unidentified
  REGION 1..245: note = Oscillospiraceae bacterium
MSKFTPRTNAPSATDKHWIKSTCGGLNECLKISGNSCLPNCVGYAWGRFYELTGEKPRLSTGNAENWYDNTADGYKRSATPKLGAVACWRKGKAFNEADGCGHVAIVEEIKPNGDIVCSNSAYGGSRFYVKEYSKSTGYNYGALTFQGFILPPVEFDSVSADELAREVIQRLTETNCDWEDVQERVTELLDSAQSAPKKSVDEIAREVIRGDWGNGDERKKRLTEAGYDYYAVQKRVNELLKSQR

SEQ ID NO: 2028 - protein, 306 aa, Gardnerella vaginalis
MSKRGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCSKLETYGYYAGFYTSLSTANNLVSAHVRNRYALWIAQWNTHCSYQGSYGLWQYSSSGSVPGVAGRVDMDYAYVDYPSIIKNVGLNGCKNGGSDQAARTSSIDEVAREVINGAWGNGNERKQRLTSAGYDYASVQNKVNKLLGVKACRKSVDELAREVIRGTWGNGSTRKQRLTSAGYDYDTVQKRVNELL

SEQ ID NO: 2029 - protein, 148 aa, unidentified
  REGION 1..148: note = Lachnospiraceae bacterium
MPEASEKTGFVKKSVDAPVEEKKGLPAGNKVVGKGLPAGNKVAGAGLPAGNKVAGAGLPAGNKVAGAGLPAGNKVAGAGLPAGNKVAEAEPANVAAGSTQDMTGKSIEELAKEVIRGNWGNGDERKQRLTEAGYDYDAIQKKVNELLK

SEQ ID NO: 2030 - protein, 319 aa, Ruminococcus sp.
MATSGIDVSQWQGTINWPQVKGKVDFALIRAGYGDTLSFPYQIDKMYEANYKGCKQAGIPVGVYFYSYASTVEQAQREADSCIALLKGKQFEYPVYYDVEEFDIFRSGNTNAIIKAFCDKLEKAGYFTGIYIYRSALQTYVNKQIRERYAVAVAEYGPKCNYDGPYGIWQNTSDWSCSGISGRVDHDYCYVDYPKIIREAGMNGFSKTVPTVKPTPAHKPAKKTVDQIAREVIAGDWGAGEERRKRLTAAGYDYDAVQNKVNEILYGTKPQPAKKSVDQIAREVIRGDWGAGEERRKRLTAAGYDYNAVQKRVNEILYG

SEQ ID NO: 2031 - protein, 414 aa, unidentified
  REGION 1..414: note = Bacillota bacterium
MGYTNSKLVVYKKLSPNHSGKRTHAIDRITPHCVVGQCTAEGLGSWFAKTSTQASSNYGIDKDGRVGLYVEEKNRSWCSSSNANDQRAVTIECASDTKEPYTMNSKVYATLVKLCVDICKRNGKKKLLWISNKSKALNYVPKSDEMILTVHRWFANKSCPGNWLYSRLGKLATEVTKQLAGSETKPSSVLKASSLKDLSDADVIKKVGALFTADMKKSGILASVSLAQFILESGYGKSELAQKANNCFGMKKSLSGNTWSGSVWDGKSIYTKKTKEQNKDGSYTTITADFRKYPSVEDSIADHSAYLLGAKNGSKKRYAGLKGCKDYKKAAKIIKDGGYATSLTYVDKLCSIIEKWKLTQYDVKTSSSSKKSIDTLAKEVIAGKWGNGEERKQKLTAAGYDYNAVQKRVNEMLS

SEQ ID NO: 2032 - protein, 238 aa, unidentified
  REGION 1..238: note = Clostridia bacterium
MNCPFKGKFKVTQQFKGSAHDGLDIVGLENKNIYSTVDGTVERAGWENSLNHKKGFGLYVRIKENNSSDRYYFGHLSKVAVKVGQRVKIGDLLGTEGNTGRSTGSHCHYCVRTDASKSKFRNICEISGIPNELGTHIGEPKKQKDIIELAMEVISGKWGNGEERRKNLENQGFDYSAVQSEVNRILENNSATAHKSIDTVANEVIKGLWGNGSERKSRLKEAGYNYSAIQKRVNEILK

SEQ ID NO: 2033 - protein, 579 aa, unidentified
  REGION 1..579: note = Clostridia bacterium
MSNKEQIRRVSAKVFFDGVDISDDIDKYLLSLTYTDNESGETDDLQIKLCDKDDIWLKSWLNKAIWAASASSYSAVASKKETSVSNLYKVSAKTGAAVHSRPGVLYYVYGTLPYGTVITVSSISDGWANFVFSGKNAYVRANLLTSTQASYNSSPQTSYDAEWQIGDAVIANGAPHESSYGSGKTGAVVTNYESTVTYLNLKAGVPYPICVGNIGWFAVTDVKHRGSASSQAEYDGACKGMKIQAVLVRHNWTGNGEDEVLDCGSFELDGVGASGPPSAINIKATSLTYNSSARQTKHSKSWESYYLKGIAEEIAQKNGMTCVFCTAKNPFYERVEQYKTSDIAFLNKLCSDAGCALKCTNNIIVIFDSVAAASSKSMVIDRNKLPSDTKYNLTTQQNSAYTSCRVSYVTPSGQLIEATAYVDDYDAENDKNQCYEVSQKVSNTAEAKALAATTLKNVNKFSINISFTFPFTTTLFAGSCVELVNYGYWSGIYAVSQAKHSIGSSASTTQITLRKLTASEIEENGKTTYNANKSIEQLALEVIRGEWGTGQERRRRLTEENYDYNAVQTMVNQILSKGG

SEQ ID NO: 2034 - protein, 267 aa, Ruminococcus sp.
MATSGIDVSQWQGTINWPQVKGKVDFALIRAGYGDTLSFPYQIDKMYEANYKGCKQAGIPVGVYFYSYASTVAQAQREADSCIALLKGKQFEYPVYYDVEEFDIFRSGNTNAIIKAFCDKLEKAGYFTGIYIYRSALQTYVNKQIRERYAVAVAEYGPKCNYDGPYGIWQNTSDWSCSGISGRVDHDYCYVDYPKIIREAGMNGFSKTVPAVKPTPAPKPAKKTVDQIAREVIAGDWGAGEERRKRLTAAGYDYDAVQKRVNEILYG

SEQ ID NO: 2035 - protein, 411 aa, unidentified
  REGION 1..411: note = Oscillospiraceae bacterium
MGYTNSKLVVYKKLSPNHSGKRTHAIDRITPHCVVGQCTAEGLGSWFAKTSTQASSNYGIDKDGRVGLYVEEKNRSWCSSSNANDQRAVTIECASDTKEPYTMNSKVYATLVKLCVDICKRNGKKKLLWISNKSKALNYVPKSDEMILTVHRWFANKSCPGNWLYSRLGKLATEVTKQLGSSTASGLKASSLKDLSDADVIKKVGALFTADMKKSGILASVSLAQFILESGYGKSELAQKANNCFGMKKSLSGNTWSGSVWDGKSVYTKKTKEQNKDGSYTTITADFRKYPSVEDSIADHSAYLLGAKNGSKKRYAGLKGCKEYKKAAKIIKDGGYATSLTYVDKLCSIIEKWKLTQYDVKSGSSSKKSIDTLAKEVIAGKWGNGEERKQKLTAAGYDYNAVQKRVNEMLS

SEQ ID NO: 2036 - protein, 290 aa, unidentified
  REGION 1..290: note = Clostridia bacterium
MAYTNSPLVVYTKRSPHHSGQRTHSIDRITPHCVVGQCTAETLGEVFNGTRDVSANYGIDKSGRVGLYVDEKNRSWCSSSRENDQRAVTIECASDTTEPYAFKDVVYKKLIELCADICRRNGKKKLLWLGDKATTLNYTPKSDEMILTVHRWFAATACPGSWMMNRMADLAKQVTAVLQGGASSGSATGTVSSTELYRVRKTWSDTKTQKGAYKNLDNAKACADKNPGWSVFNSSGKSIYSSKEATKTVDELAREVINGKWGNGADRKKRLTAAGYDYNAVQRRVNELLK

SEQ ID NO: 2037 - protein, 165 aa, unidentified
  REGION 1..165: note = Erysipelotrichaceae bacterium
MASLKESLSNLFGKKEEEKKTETTTVKPATTTVKPATTTVKPATVKPATVTTGASTIKPATVTVKPTVTVTPAKKTVEEVAKEVIEGKYGNGEERKAALAKAGYDYATVQAKVNEILGAAAKSLDAVARDVIQGKYGNGEERKAALAKAGYDYAAVQARVNELLK

SEQ ID NO: 2038 - protein, 290 aa, Eubacterium siraeum
MMKIKGIDLSYCQEGISFPALKQAGVKFAIIRAGFSTKKDVTMDKFVADCKKYGIDYGFYWYSYAMSVEQAEAEAEKCISVIKELSPTYPVFFDMEEKKQISGLNTDTRTKMTVAFCEKIRQAGFMPGIYANPSFMENYYNKNRIVGKYDIWLAHWTNSPDCPSGFSYGQTMWQWGLDRIGGYDVDGDICFTDYSKKKPVKKTIDQLADEVLAGKWDNGAEREKQLTAAGYDYNAVQKRVNEKLYRKTTDEIAVEVIAGLWGNGAERKEKLTEAGYDYSKVQRKVNQMIK

SEQ ID NO: 2039 - protein, 307 aa, unidentified
  REGION 1..307: note = Murdochiella sp. Marseille-P8839
MTIKGIDVSTWQGSIDFKRVKQSGINFVIIRAGYGSALSQKDKWFETNYARAKAAGLHVGAYWYSYAGSAGEAREEARVYKQVLSGKQFDYPIYFDIEEKSQLSRGRAFCDSLIRAFCNEMEAGGYYAGFYTSLSSALNNVSSDVRNRYAFWIAQWNSYCTYQGQYGLWQYSSSGSVPGIAGRCDMDLAYVDYPSIIRKGGFNGYGKGTRSAPARKSVDTLAHEVISGAWGNGEDRVNRLTKTGYDYDAVQARVNELLGIKPKKSIDTLAREVIRGDWGNGADRKKRLAKAGYDYRAIQKRVNELLK

SEQ ID NO: 2040 - protein, 286 aa, Streptococcus gallolyticus
MAYTNSKLVSYTKLSPNHSGHRTHSIDRITPHCVVGQCSVETLGNIFAPTSRQASCNYGIGSDGRVGMYVEEKNRSWCSSSNANDQRAVTIECASDTKHPYTMNSTVYATLIKLCVDICKRNGKKKLIWLGDKNKTLNYSPKSDEMVLTVHRWFANKSCPGDWLYSRLGDLASKVTAQLGGSSSGGTTASGLYRVRKSWNDAKSQKGAFKSLDNAKRCAASNPGYFVFDENGRIVGSTTSSTKTVDELAREVIRGNWGDGAERKNRLTAAGYDYNAVQKRVNELLK

SEQ ID NO: 2041 - protein, 340 aa, Clostridium innocuum
MSYTNSSLVSYTKLSPNHSGQRTHSIDRITPHCVVGQLSAESICACFPAGRDASCNYGIGTDGRVSLCVEEKNRSWCSSSNANDQRAATIECASDRTEPYAMNSKVYDSLVRLCTDICRRNGKKKLLWFSDKNKSLNYNPKPDEMVLTVHRWFANKSCPGNWLYARLGDLANEVTAALGGTATNTPSTGESTWYRVRKSWSDAKSQKGAFHNLANAKKCADANTGYKVFDESGNQIYPVAVAPSPSIDSIAREVINGHWGNGNERKQRLTTAGYDYNVVQARVNEILNSGAAGVKTKSIDMIAREVIQGTWGNGDTRKQRLTAAGYDYAAVQSRVNEILK

SEQ ID NO: 2042 - protein, 290 aa, Eubacterium siraeum
MMKIKGVDLSYCQEGISFPALKQVGVKFAIIRAGFSTKKDVTMDKFVVDCKKYGIDYGFYWYSYAMSIEQAQAEAEKCIEVIKNLSPTYPVFFDMEEKKQISGLNTDTRTKMAIAFCEKIRQAGLKPGIYANPSFMENYYDKNRIIGKYDIWLAHWTNSPNCPSKYSYGQTMWQWGLDRIDGYDVDGDICFFDYAKSAHEKKTVDELADEVIAGKWDNGAERERLLTAAGYDYNAIQKRVNEKLYRKTTDEIAVEVIAGLWGNGAERKEKLTEAGYDYSEVQKRVNEMLR

SEQ ID NO: 2043 - protein, 312 aa, unidentified
  REGION 1..312: note = Bacilli bacterium PM5-9
MKTKGIDISTWQKPSQINYDQLAKEVDFVILRAGYTGHGTGVSLHKDDAFEKHYKAFHERGIPIGVYWYSCANTKDKGIAEAKKCLEIIKGKTISYPVFIDTEDNYHQRPSGKKAITDALVGFCETVESAGYYAGIYASSSWFQDLTELDRLAPYDFWVAQWSSKEPTLRHGIWQYTSKGKLSGYSGNLDMNYAYKDYKAIIQSAGLNHLGKEENMPAPTEKKSVETLAKEVIQGLWGNGEERKKRLTDAGYDYVAVQSKVNEMLSSKKSIDAIAKEVIRGDWGNGQERKNKLTKAGYDYISVQKRVNELLK

SEQ ID NO: 2044 - protein, 511 aa, Clostridium perfringens
MKLVESILTKNPCYTAGRKIDVKGLMLHSVGCSQPRASAFINSWNSPTFDRACVHGFIDGNDGTVYQTLPWNHRGWHCGSSINGSGNNTHIGVEMCEPACITYTGGATFKCSDPATAKAVAERTYRAAVELFAMLCKEFHLDPLADGVVISHKEGHARGISSNHGDPEHLWSQLGMGYTMDTFRKAVKEQMGGKADTKQGTQASVFSGLSEKGAVPIIGELCREDMKKSGVLASVSAAQFILESGYGKSELGQNANNMFGMKKSLSGNTWAGSTWDGTSVYTKKTQEQHTDGTYETITADFRKYPCVEDSVADHSAYLLGAKNGRSLRYKGIKGMTDYKAVARLIKEGGYATSLTYVEKLCNIIEKWNLTQYDVKDAPAPKPSTPDTVTEFPATPFSVKVIIDDLNYRSEPSMNGKVNGQTGKGTFTIMEVKNGGWGRLKSGAGWIWLSNPTYCTVGKTVKITEDKKKSIDELAKEVIRGDWGNGTERKEKLTAAGYDYASVQKRVNEMLK

SEQ ID NO: 2045 - protein, 269 aa, Anaerococcus sp.
MTYSKLVDDIILSPNHSGKRSEKISKIAIHHAGGIIGGRDLARLFLPKSRGASANYNLGSDGIIVLGVYEENRAWTTSSSWCDNRAITIEVGNSTRGPNWEISDFVLNKLIDLVTDICMRNNIYPCTYTGDKEGVLQKHFWYANTNCPGPFLGNKFSYIAKEVNKRLRKNPSKNLNLYRVRKSFEDKKSQKGAFKSLVNAKKCADKYKEKVFDDMGNEIYPRKNLKSIDQIAKEVIRGDWENGNERKKRLIDAGYDYYAVQKRVNQILS

SEQ ID NO: 2046 - protein, 264 aa, unidentified
  REGION 1..264: note = Acutalibacteraceae bacterium
MTDRERFLNTAKGYIGTNGNYVCKTNLGLGAVYDWCAFAVSAIMKDCGFIGKYIKSVNGGAGDVPRTSDGKYGDWFKKGTKAPQAGDLFFMRYADYPYQDKYFCDHVGIVESVNGNTITTLEGNVDGYSYNWAGTSTFKRKTRYLSDGTVYAFYRPRWSGTTSTSTSQTNKKSVYELAKEVIAGKWSAGEERKQKITAAGYNYSAVQNRVNELLSGKTPQKSVDELAREVIQGKWGNGEERRKKLTAAGYNYSAVQNRVNELMR

SEQ ID NO: 2047 - protein, 289 aa, Eubacterium siraeum
MMKIKGVDLSYCQEGISFPALKQAGVKFAIIRAGFSTKKDVTMDKFVADCKKHSIDYGFYWYSYAMSVEQALTEAEKCIEVIKNLSPTYPVFFDMEEKKQISGLNTDTRTKMAIAFCEKISQAGFKPGIYANPSFMENYYDKSKIVGRYDIWLAHWTNSPDCPSKYNYCQTMWQWGLDRIGGYDVDGDICFTDYGKKKPVEKTIDQLADEVLAGKWDNGAERERLLTAAGYDYNAVQKRVNEILNKKTVDEIANEVIRGEWGNGAERKEKLTAAGYDYFAVQKRVNEML

SEQ ID NO: 2048 - protein, 290 aa, Eubacterium siraeum
MMKIKGVDLSYCQEGISFPALKQAGVRFAIIRAGFSTKKDVTMDKFVADCKIHGIEYGFYWYSYAMSVEQAQTEAEKCIEVIKNLSPTYPVYFDMEEKKQVSGLSTDTRTKMAIAFCEKISQAGFKPGVYANPSFMENYYDKSRIVGRYDIWLAHWTNSPNCQSKYNYGQTMWQWGLDRIGRYNVDGDICFTDYGKKKPFEKTVDQLADEVVAGKWDNGAERERLLTAAGYDYNAVQKRVNEKLYKKTVDEIAVEVIAGLWGNGAERKKKLTEAGYDYSEVQRKVNQMIK

SEQ ID NO: 2049 - protein, 243 aa, Gardnerella vaginalis
YANSSSEAAEEAQSCVNMLSGKSFEYPVYFDLEEKSQLNRGRAFCDSLITSFCSKLETYGYYAGFYTSLSTANNLVSAHVRNRYALWIAQWNTHCSYQGSYGLWQYSSSGSVPGVAGRVDMDYAYKDYPSIIKNVGLNGCKNGGSDQAARTSSIDEVAREVINGAWGNGNERKQRLTSAGYDYASVQNKVNELLGVKAYRKSVDELAREVIRGAWGNGSTRKQRLTSAGYDYDTVQKRVNELL

SEQ ID NO: 2050 - protein, 286 aa, unidentified
  REGION 1..286: note = Faecalicoccus pleomorphus
MTYTNSKLVSYTKLSPNHSGHRTHSIDRITPHCVVGQCSVETLGNIFAPTSRQASCNYGIGPDGRVGMYVEEKNRSWCSSSNANDQRAVTIECASDTKHPYTMNSTVYATLIKLCVDICKRNGKKKLIWLGDKSKTLNYSPKSDEMVLTVHRWFANKSCPGDWLYSRLGDLASKVTAQLGGSSSGGTTASGLYRVRKSWNDAKSQKGAFKSLDNAKRCAESNPGYFVFDESGRIVGSTTSSTKTVDEIAREVIRGNWGNGAERKNRLTAAGYDYNAVQRKVNELLK

SEQ ID NO: 2051 - protein, 289 aa, unidentified
  REGION 1..289: note = Clostridium sp. AM32-2
MLPTNSSLVSYTKLSPNHSGQRTHSIDRITPHCVVGQLSCESICGCFTSPSRQASCNYGIGKDGRISLCVEEKNRSWCSSSNANDQRAVTIECASDTKHPYTMNSTVYATLIKLCVDICKRNGKKKLIWLGNKKKTLNYSPKSDEMVLTVHRWFANKSCPGDWLYARLGDVAAKVTAELSGASTSTGTVTATGLYRVRKIWADAKSQKGAFKSLENAKKCAASNPGYSVFDANGNVVSGSNTSTIKTVDELAKEVIKGLWGNDADRRNRLTAAGYDYNAVQRRVNELLK

SEQ ID NO: 2052 - protein, 306 aa, unidentified
  REGION 1..306: note = Bifidobacteriaceae bacterium WP022
MSKKGIDVSEWQGDIDFNAVKASGVEFVIIRAGYGIGCKDKWFEQNYRKAKACGLDVGAYWYSYANSSSEAAEEAQSCVNMLSGKSFEYPVYFDLEEKSQLNRGRAFCDSLITSFCSKLETYGYYAGFYTSLSTANNLVSAHVRNRYALWIAQWNTHCSYQGSYGLWQYSSSGSVPGVAGRVDMDYAYKDYPSIIKNVGLNGCKNGGSDQAARTSSIDEVAREVINGAWGNGNERKQRLTSAGYDYASVQNKVNELLGVKAYRKSVDELAREVIRGAWGNGSTRKQRLTSAGYDYDTVQKRVNELL

SEQ ID NO: 2053 - protein, 251 aa, unidentified
  REGION 1..251: note = Bifidobacterium animalis subsp. lactis
MNAAAGKADAERFIQLLKGKQLEYPVFMDNEAQPASAKAGITEATIAFCETMEGAGYFVGIYGSTDSGFHERMDDSRLTAYTHWVAQYASKCTYSGPYGIWQHSSSGRVNGISGNVDMDLSYVDYPSAIKNGGFNGYAKGTATGSTPAAPTKKSVDEIASEVIAGKWGNGDDRRNRLTTAGYNYSAVQSKVNEKLGATAKQPAVYYTVKRGDTLSAIASKYGTSVSAIQKLNSSLIKNVNLIQVGWRIRVK

SEQ ID NO: 2054 - protein, 304 aa, unidentified
  REGION 1..304: note = Atopobium
MAVKGIDVSVWQKSIDFNKVKRSGIEFVIMRAGYGSALSQKDKCFEQNYARAKAAGLHIGAYWYSYAKSAAQAIQEAKVCKQVLSGKQFDYPIYFDIEEKSQLSRGRVFCDSLIRAFCNEMEAGGYFAGFYTSLSSALNNVSSDVRNRYAFWIAQWNSYCTYQGAYGLWQYSSSGSVPGISGRCDMDLAYVDYPSIIRKGGFNGYGKGSAPARKSVDQLAHEVISGSWGNGDERKKRLTEAGYSYDAVQDKVNELLGVKSRKSIDQLAREVIRGNWGNGQDRKNRLTRAGYDYSAVQKRVNQLL

SEQ ID NO: 2055 - protein, 328 aa, Streptococcus constellatus
MSNSSLVNMTMLSPNHSGHRNQPITKIAIHHTAGAISAATIGQIFRPTSRQAYCNYGIGNDNKIVLCVDEANRSWCTSSSWCDNRAVTIEVANSANGGNWPVSDRTLATLIDLVTDICRRNGIRNCTYTGGKDGVLQKHEWYANTNCPGPYLGSKFSYIASEVNKRLSGNSSSSGGTSTSSLYRVRKSWSDVKSQKGAFRDFDNAKKCANANAGYKVFDASGNEVYPNKVTISKSVDTLAHEVLAGNWGNGSDRANRLRAAGYDYDTVQNRVNEILSGTNSNPNRKPIDILAREVIIGDWGNGQDRVNRLTSAGYDYNAVQKRVNETL

SEQ ID NO: 2056 - protein, 306 aa, Gardnerella vaginalis
MSKKGIDVSEWQGDIDFNAVKASGVEFVIIRAGYGIGCKDKWFEQNYRKAKTAGLDVGAYWYSYANSGFEAAEEAQSLMNMLSGKSFEYPVYFDLEEKSQLNRGRAFCDSLITSFCNKLEACGYYAGFYTSLSTANNLVSAHVRNRYALWIAQWNTHCNYQGSYGLWQYSSNGSVPGVAGRVDMDYAYVDYPSIIKNAGLNGCKNGGSDQAARTSSIDEVAREVINGAWGNGSTRKQRLTSAGYDYASVQNKVNELLGVKACRKSVDELAREVIRGAWGNGSTRKQRLAQAGYDYDTVQKRVNELL

SEQ ID NO: 2057 - protein, 299 aa, unidentified
  REGION 1..299: note = Clostridia
MDKQTFISQIAAYVIKYAAQYGIKVHSPIIAQAILESGWGQSSLAAKYHNYFGLKCGSAWTGKSVNMATSEEYTPGVHTNIRDNFRVFDSMEDGVKGYFDFINYSRYANLKGVTDPQTYVENIKADGYATSSTYVTNLMRVIRDNNLTQYDGAAQQTPSKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQARVNDLM

SEQ ID NO: 2058 - protein, 307 aa, unidentified
  REGION 1..307: note = Levyella massiliensis
MTIKGIDVSTWQGSIDFNRVKQSGINFVIIRAGYGSALSQKDKWYETNYARAKAAGLHVGAYWYSYAGSAGEAREEARVCKQVLSGKQFDYPIYFDIEEKSQLSRGRAFCDSLIRAFCNEMEAGGYYAGFYTSLSSALNNVSSDVRNRYAFWIAQWNSYCTYQGQYGLWQYSSSGSVPGIAGRCDMDLAYVDYPSIIRKGGFNGYGKGTRSAPARKSVDTLAHEVISGAWGNGEDRVNRLTKTGYDYDAVQARVNELLGIKPKKSIDTLAREVIRGDWGNGADRKKRLAKAGYDYRAIQKRVNELLK

SEQ ID NO: 2059 - protein, 306 aa, unidentified
  REGION 1..306: note = Gardnerella greenwoodii
MSKKGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCSKLETYGYYAGFYTSLSVVNNLVSAHVRDRYALWIAQWNTHCSYQGSYGLWQYSSSGSVPGVAGRVDMDYAYKDYPSIIKNAGLNGCKNGGSHQAARTSSIDEVAREVINGAWGNGNERKQRLTSAGYDYASVQNKVNKLLGVKACRKSVDELAREVIRGTWGNGSTRKQRLTSAGYDYDTVQKRVNELL

SEQ ID NO: 2060 - protein, 317 aa, Ruminococcus torques
MAYTNSNMVAYTKLSPNHSGQRTHGIDRITPHCVVGQCTAEGLGDWFAKSSTQASSNYGIDKNGRVGLYVEEKNRSWCSSSGANDQRAVTIECASDTSEPYAMNSAVYATLIKLCVDICKRNGKKKLIWFGDKDKTLNYSPKSDEMILTVHRWFANKSCPGNWLYARLGDLASKVTAQLGGAASTPAGGSQTPVSKFPAVPFTVKVIIDDLNYRSEPSMNGKVNGQTGKGVFTIMEVRDGWGRLKSGAGWIYLENPSYCTIGNTSSSAVKTTTKSVDTLAREVIQGKWGNGTDRKNRLTAAGYNYSAVQKRVNELLK

SEQ ID NO: 2061 - protein, 306 aa, Gardnerella vaginalis
MSKKGIDVSVWQGDIDFNAVKASGVEFVIIRAGYGIGHKDKWFEENYRKAKTAGLDVGSYWYSYASSAGEVALEAQSCVNILSGKSFEYPVYFDLEEKSQLNRGRDFCDSLITSFCNKLEACGYYAGFYTSLSVANNLVSSHVRDRYALWIAQWNTHCSYQGSYGLWQYSSSGSVNGIAGRVDMDYAYVDYPSVIKNAGLNGYQNGGSYTAPQTSSIDEVAREVINGDWGNGIERKNRLTSAGYDYTSVQNKVNELLGVKAYRKSVDELAREVIRGTWGNGKTRKQRLTQAGYDYNAVQKRVNELL

SEQ ID NO: 2062 - protein, 283 aa, Atopobium minutum
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPAWGKNIFGHRDFSATECPASIAGSQHGAYMARAGYWYDQMTSSKTSTPAAAPTSKPAPSGCKSIDTLAHEVINGSWGNGNDRYQRLTAAGFDYDAVQARVNEILGFKAKPAGKSIETLAREVIRGDWGNGQERYNRLTNAGYNYQQVQNRVNQILS

SEQ ID NO: 2063 - protein, 306 aa, unidentified
  REGION 1..306: note = Gardnerella
MSKRGIDVSVWQGDIDFNAVKASGVEFVIIRAGYGIGHKDKWFEENYRKAKTVGLDVGAYWYSYASSAGEASEEAQSCVNILSGKSFEYPVYFDLEEKSQLNRGRDFCDSLITSFCNKLEACGYYAGFYTSLSVANNLVSSHVRDRYALWIAQWNTHCSYQGSYGLWQYSSSGSVNGIAGRVDMDYAYVDYPSVIKNAGLNGYKNGGSYTAPQISSIDEVAREVINGDWGNGNERKQRLTSAGYDYASVQNKVNELLGVKAYRKSVDELAREVIRGTWGNGSTRKQRLTQAGYDYNAVQKRVNELL

SEQ ID NO: 2064 - protein, 312 aa, Listeria monocytogenes
MKTKGIDISTWQKPSQINYDHLAKEVDFVILRAGYTGHGTGVSLHKDDAFEKHYKAFHERGIPIGVYWYSCANTKTKGIAEANKCLEIINGKTISYPVFIDTEDNYHQRPSGKKAITDALVGFCETVENAGYYAGIYASSSWFQELTELDRLAPYDFWVAQWSSKEPTLRHGIWQYTSKGKLNGYSGKLDMNYAYKDYKTIIQRAGLNHLGKEENAPAPTEKKSVETLAKEVIQGLWGNGEERKKRLTDAGYDYAAVQSKVNEMLSSKKSIDAIAKEVIRGDWGNGQERKNKLTKAGYDYVSVQKRVNELLK

SEQ ID NO: 2065 - protein, 306 aa, unidentified
  REGION 1..306: note = Gardnerella swidsinskii
MSKKGIDVSVWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCNKLEACGYYAGFYTSLSTANNLVSAHVRNRYALWIAQWNTHCSYQGSYGLWQYSSSGSVPGVAGRVDMDYAYVDYPSIIKNAGLNGYKNGESHQATRTTSIDEVAREVINGAWGNGNERKQRLTSAGYDYASVQNKVNELLGVKACRKSVDELAREVIRGAWGNGSTRKQRLTSAGYDYDTVQKRVNELL

SEQ ID NO: 2066 - protein, 274 aa, unidentified
  REGION 1..274: note = Peptoniphilus asaccharolyticus
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKSTNCPGPYLGSKFPYIANEVNKRLRCNKTVSKPTGGLYRVRKSWSDVKSQKGAFKNLENAKKCVNANPGYAVYDANGRSLYPVASAPSKSVDTLAREVIAGNWGNGQDRKNRLERAGYDYNAVQRRVNELL

SEQ ID NO: 2067 - protein, 306 aa, Gardnerella vaginalis
MSKRGIDVSVWQGDIDFNAVKASGVEFVIIRAGYGIGHKDKWFEENYRKAKTAGLDVGAYWYSYASSAGEASEEAQSCVNILSGKSFEYPIYFDLEEKSQLNRGRAFCDSLITSFCSKLETYGYYAGFYTSLSVANNLVSSHVRDRYALWIAQWNTHCDYQGSYGLWQYSSSGSVDGIAGRVDMDYAYVDYPNVIKNAGLNGYKNGGSYTAPQTSSIDEVAREVINGDWGNGNERKNRLTQAGYDYTSVQNKVNELLGVKAYRKSVDELAREVIRGTWGNGSTRKQRLTQAGYDYDTVQKRVNELL

SEQ ID NO: 2068 - protein, 283 aa, unidentified
  REGION 1..283: note = Actinotignum urinale
MKNWNTLEADLNLLMNKHFTKGRQGRSINKIILHHNDGNLSIQGCWNVWQTRPASAHYQVETSGRIGQLVWDRDTAWHAGNWDANLTSIGIEHADASTHPYRISDACLENGAHLVAALCHYYKLGRPVWGKNIFGHRDFSATECPASIAGSQHGAYMARAGYWYDQMTSSKTSTPAAAPASKPAPSGCKSIDTLAREVINGSWGNGNDRYQRLTAAGVDYDAVQARVNEILGFEAKPAGKSIETLAREVIRGDWGNGQERYNRLTNAGYNYQQVQNRVNQILG

SEQ ID NO: 2069 - protein, 306 aa, unidentified
  REGION 1..306: note = Gardnerella leopoldii
MSKKGIDVSEWQGDIDFNAVKASGIEFVIIRAGYGIGCKDKWFEQNYRKAKTVGLDVGAYWYSYANSSSEAAEEAQSLMNMLSGKSFEYPVYFDLEEKSQLNRGRAFCDSLITSFCNKLEDCGYYAGFYTSLSTANNLVSAHVRNRYALWIAQWNTHCSYQGSYGLWQYSSSGSVPGVAGRVDMDYAYVDYPSIIKNAGLNGCKNGGSDQAARTSSIDEVAREVINGAWGNGSTRKQRLTSAGYDYASVQNKVNELLGVKACRKSVDELAREVIRGAWGNGSTRKQRLAQAGYDYDTVQKRVNELL

SEQ ID NO: 2070 - protein, 319 aa, unidentified
  REGION 1..319: note = Amedibacterium intestinale
MIKIIQNLVSKAKYGIKCPYSMKPTRIVVHNTANDAPAKNEISYMISNDNEVSFHFAVDDKEVIQGIPLDRNAWHAGDGGNGKGNREGIAIEICYSKSGGERFEKAERLAAELIAQLLKERGWRIDKVTKHQDYSDKYCPHRTLDMGWQRFLDMVKKELGDNSSDTSNKKSIDEVVDEVIAGKWGNGNDRKKQLEAAGYDYNVIQSKVNAKLNGSSSTSSKPSKTISQIADEVIAGKWGNGNDRKQRLEKAGYNYNEVQKKVNEKLGGASSSKPAKKSNETIAKEVIRGDWGNGSERKKRLEAAGYNYNTIQNLVNKML

SEQ ID NO: 2071 - protein, 306 aa, Gardnerella vaginalis
MSKKGIDVSVWQGDIDFNSVKASGVEFVIIRAGYGIGHKDKWFEENYRKAKTAGLDVGAYWYSYASSAGEAAEEAQSCVNILSGKSFEYPVYFDLEEKSQLNRGRDFCDSLITSFCNNLEACGYYAGFYTSLSVANNLVSSHVRDRYALWIAQWNTHCDYQGSYGLWQYSSSGSVGGIAGRVDMDYAYVDYPSVIKNAGLNGYENGGSYSAPQTSSIDEVAREVINGAWGNGNERKSRLTQAGYDYTSVQNKVNELLGVKAYRKSVDELAREVIRGTWGNGSMRKQRLTQAGYDYNAVQKRVNELL

SEQ ID NO: 2072 - protein, 328 aa, Streptococcus constellatus
MSNSSLVNMTMLSPNHSGHRNQPITKIAIHHTAGAISAATIGQIFRPTSRQASCNYGIGNDNKIVLCVDEANRSWCTSSSWCDNRAVTIEVANSANGGNWPVSDRTLATLIDLVTDICRRNGIRNCTYTGGKDGVLQKHEWYANTNCPGPYLGSKFSYIASEVNKRLSGNSSSSGGTSTSSLYRVRKSWSDVKSQKGAFRDFDNAKKCANANAGYKVFDASGNEVYPNKVTISKSVDTLAHEVLAGNWGNGSDRANRLRAAGYDYDTVQNRVNEILSGTNSNPNRKPIDILAREVIIGDWGNGQDRVNRLTSAGYDYNAVQKRVNETL

SEQ ID NO: 2073 - protein, 411 aa, unidentified
  REGION 1..411: note = Hornefia butyriciproducens
MGYTNSKLVVYKKLSPNHSGKRTHAIDRITPHCVVGQCTAEGLGSWFAKTSTQASSNYGIDKDGRIGLYVDEKNRSWCSSSNANDQRAVTIECASDTKEPYTMNSKVYATLVKLCVDICKRNGKKKLLWISNKSKALNYVPKSDEMILTVHRWFANKSCPGNWLYSRLDKLATEVTKQLSSSTASGLKASSLKDLSDADVIKKVGALFTADMKKSGILASVSLAQFILESSYGKSELAQKANNCFGMKKSLSGNTWSGSVWDGKSVYTKKTKEQNKDGSYTTITADFRKYPSVEDSIADHSAYLLGAKNGSKKRYAGLKGCKDYKKAAKIIKDGGYATSLTYVDKLCSIIEKWKLTQYDVKSSSSSKKSIDTLAKEVIAGKWGNGEERKQKLTAAGYDYNAVQKRVNEILS

SEQ ID NO: 2074 - protein, 269 aa, unidentified
  REGION 1..269: note = Peptoniphilaceae
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYSSTNCPGPYLGSKFPYIAREVNKRLRDNKTVSKSIGGLYRVRKSWSDVKSQKGAFKNLDNAKRCADRFGLKVFDVNGKIVYPVGKTIDELAKEVISGKWGNGEERKRRLTNAGYDYYVIQRRVNQLL

SEQ ID NO: 2075 - protein, 319 aa, unidentified
  REGION 1..319: note = Amedibacterium intestinale
MIKIIQNLVSKAKYGIKCPYSMKPTRIVVHNTANDAPAKNEISYMISNDNEVSFHFAVDDKEVIQGIPLDRNAWHAGDGGNGKGNREGIAIEICYSKSGGERFEKAERLAAELIAQLLKERGWRIDKVTKHQDYSDKYCPHRTLDMGWQRFLDMVKKELGDNSSDTSNKKSIDEVVDEVIAGKWGNGNDRKKQLEAAGYDYNVIQSKVNAKLNGSSSTSSKPSKTISQIADEVIAGKWGNGNDRKQRLEKAGYNYNEVQKKVNEKLGGASSSKPAKKSNETIAKEVIRGDWGNGAERKKRLEAAGYNYNTIQNLVNKML

SEQ ID NO: 2076 - protein, 282 aa, unidentified
  REGION 1..282: note = Mobiluncus
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNVFGHRDFSATECPASIAGSQHATYMARAGYWYDQMSSGKASATPAPASKPAPTGCKSIDTLAREVINGSWGNGNDRHQRLTAAGFDYDAVQARVNEILGLKSKPAGKSIETLAREVIRGDWGNGQERYNRLTNTGYNYQQVQNRVNQILG

SEQ ID NO: 2077 - protein, 282 aa, Mobiluncus curtisii
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPVWGKNVFGHRDFSSTECPASIAGSQHAAYMARASYWYDQMTGSNTPATPAPAPKATTTGDKSIDTLAREVINGSWGNGNDRHQRLTAAGFDYDQVQARVNEILGITPKPAGKSIETLAREVIRGDWGNGQERYNRLTNAGYNYQQVQNRVNQILN

SEQ ID NO: 2078 - protein, 306 aa, Gardnerella vaginalis
MSKKGIDVSEWQGDIDFNAVKASGIEFVIIRAGYGIGCKDKWFEQNYRKAKTAGLDVGAYWYSYANSASEAALEAQSCVNMLSGKSFEYPVYFDLEEKSQLNRGRAFCDSLITGFCSKLETYGYYAGFYTSLSVANNLVSAHVRDRYALWIAQWNTHCNYQGSYGLWQYSSSGSVPGVAGRVDMDYAYVDYPSIIKNAGLNGCKNGGSNQAARTSSIDEVAREVINGAWGNGNERKQRLTSAGYDYASVQNKVNELLGVKACRKSVDELAREVIRGAWGNGSTRKQRLTQAGYDYDTVQKRVNELL

SEQ ID NO: 2079 - protein, 511 aa, Clostridium perfringens
MKLVESILTKNPCYTAGRTITVKGLMLHSVGCSQPSALAFIKNWNSPSFDRACVHGFIDGNDGTVYQTLPWNHRGWHSGSSINGSANNTHIGVEMCEPACITYTGGATFKCSDIATAKTVVERTYKAAVELFAMLCEKFSLDPLADGVIISHKEGHSRGIASNHGDPEHLWSQLGMGYTMDTFRKAVKSAMEDSENTKEGTRASVFAGLSEKDAVSVIGELCREDMKKSGILASISAAQFILESGYGKSELGQNANNMFGMKKSLSGNTWTGSTWDGTSVYTKKTQEQNADGSYETITADFRKYPCVEDSVADHSAYLLGAKNGRSLRYKGIKGMTDYKAVARLIKEGGYATSLTYVEKLCNIIEKWNLTQYDVKDAPAPKPSTPDTVTEFPATPFSVKVIIDDLNYRSEPSMNGKVNGQTGKGTFTIMEVKNGGWGRLKSGAGWIWLSNPTYCTVGKTVKITEDKKKSIDELAKEVIRGDWGNGTERKEKLTAAGYDYASVQKRVNEMLK

SEQ ID NO: 2080 - protein, 277 aa, unidentified
  REGION 1..277: note = Bulleidia sp. zg-1006
MSYSALTNKVILSPNHSGRRNQPVSKITIHHMAGNLSIETCGNVFKPKSRKASSNYGIGSDGRIACYVEEENRAWTSSSPWNDHRAITIEVANNEIGGKWNISDKAYSSLIKLCFDICKRYNINPYYDGTKNATLTEHRMFAATACPGETIHNLLAGHKIENDIKKSLVVEKPKPAPAQPAQKSLNEVAREVIQGKWGNGAERKAKLEKAGYNYNTIQSLVNELVRGNRSATPSKSIDQIAREVIQGKWGNGAERKERLTKAGYDYNAVQRRVNQLL

SEQ ID NO: 2081 - protein, 282 aa, unidentified
  REGION 1..282: note = Vescimonas fastidiosa
MPKVFLSPSNQYDNRYAYGGTTEAVQCGKIAEACKAALERSGMTVQVGHMIHMSEKIAQSNAFGADLHVPIHTNAFNGTVTGTRMFCFSSGGEGMKACKAIFARLAPITPGTSESIQVNDYDEIVYTNAPAAYVECEFHDNATTAKWIVEHTTDIGEAIAQGICDYFGVTFKEKEQPTPAKSVDEVAREVIRGEWGNGSDRRQRLEAAGYDYDTVQDRVNAILTGDAPEQPTPAEPVEPAPEPEQPATDKLYRVQVGAFANRENAEKLLAKLKAAGFEGFIR

SEQ ID NO: 2082 - protein, 312 aa, unidentified
  REGION 1..312: note = Eubacterium limosum
MKTTGIDISTWQKPSQINYDQLAKEVDFVILRAGYTGHGTGVSLHKDNAFEKHYKAFHERGIPIGVYWYSCANTNAKGVAEAKKCLEIIKGKSISYPVFIDTEDNYHQRPSGKKAITDALVGFCETVENAGYYAGIYASSSWFQDLTELDRLAPYDFWVAQWSNKEPTLRHGIWQYTSKGKLSGYSGNLDMNYAYKDYKAIIQSAGLNHLAKEESTPAPTEKKSVETLAKEVIQGLWSNGEERKKRLTDAGYDYAAVQSKVNEMLSSKKSIDAIAKEVIRGDWGNGQERKNKLTKAGYDYVSVQKRVNELLK

SEQ ID NO: 2083 - protein, 276 aa, Streptococcus ictaluri
MNVGRLASIDFVVIHNDAGSMTPEQYINWLRNRNKELGIAHYYINRHTIARVIDTYNIGYHTGEWHSNTHSIGYEVCEGLKVGDKEFLENEDMTLMQATEDLLFYGLPINHQTVRLHHEFTPTTCPHRSLALHGGTTQSVKDYFVSRMKYFATLGKTVDEMLAKKGAPTSTPKPTIQPSSSKKSIDEVAREVLNGKWGNGAERKSALESAGYSYSQVQQRVNDLIYGTIPQTKSVDEVAKEVINGQWGNGQDRRNRLMGAGYNYDEIQRRVNELLG

SEQ ID NO: 2084 - protein, 124 aa, unidentified
  REGION 1..124: note = Ligilactobacillus ceti
MDMSYVDYPAIIKNMGFNGYAKGTTSKSVSKTKSVDELADEVLEGKWGNGNDRYNRLTNAGYDYDRVQDKVNEKLGITRTLKSVDTIAREVIHGDWGNGEERYNRLTNAGYDYDKVQTRVNELI

SEQ ID NO: 2085 - protein, 264 aa, Bifidobacterium animalis
MAVGAYYFVGPKCVNAAAGKADAERFIQLLKGKQLEYPVFMDNEAQPASAKAGITEATIAFCETMEGAGYFVGIYGSTDSGFHERMDDSRLTAYTHWVAQYASKCTYSGPYGIWQHSSSGRVNGISGNVDMDLSYVDYPSAIKNGGFNGYAKGTATGSTPAAPTKKSVDEIASEVIAGKWGNGDDRRNRLTTAGYNYSAVQSKVNEKLGATAKQPAVYYTVKRGDTLSAIASKYGTSVSAIQKLNSSLIKNVNLIQVGWRIRVK

SEQ ID NO: 2086 - protein, 306 aa, Gardnerella vaginalis
MSKKGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCNKLEACGYYAGFYTSLSTANNLVSAHVRDRYALWIAQWNTHCNYQGSYGLWQYSSSGSVPGVAGRVDMDYAYVDYPSIIKNAGLNGCKNGGSDQAARTSSIDEVAREVINGAWGNGNERKQRLTSAGYDYASVQNKVNELLGVKACRKSVDELAREVIRGAWGNGSTRKQRLTSAGYDYDTVQKRVNELL

SEQ ID NO: 2087 - protein, 306 aa, unidentified
  REGION 1..306: note = Gardnerella sp. Marseille-Q2328
MSKKGIDVSEWQGDIDFNAVKASGVEFVIIRAGYGIGCKDKWFEQNYRKAKTCGLDVGAYWYSYANSSSEAAEEAQSCANMLSGKSFEYPVYFDLEEKSQLNRGRAFCDSLITSFCNKLEACGYYAGFYTSLSTANNLVSSHVRDRYALWIAQWNTHCDYQGSYGLWQYSSSGSVPGVAGRVDMDYAYVDYPSIIKNAGLNGCKNGGSDQAARTSSIDEVAREVINGAWGNGSTRKQRLTSAGYDYASVQNKVNELLGVKAYRKSVDELAREVIRGAWGNGSTRKQRLTQAGYDYDTVQKRVNELL

SEQ ID NO: 2088 - protein, 289 aa, Anaerofustis stercorihominis
MAYTNSKMVVYTKLSPNHSGQRTHAIDRITPHCVVGQCSVETLGNIFYPASRQASCQYGIGPDGRVGMYVEEKNRSWCSSSNANDQRAVTIECASDTKHPYTMNSTVYATLIKLCVDICKRNGKKKLIWLGDKNKTLNYSPKSDEMVLTVHRWFANKSCPGDWLYSRLGDLASKVTAQLGGSNSATGNGTSTSGFYRVRKSWNDAKSQKGAFKYLDNAKRCAKANPGYFIFDENGKIVGSNASSTKTVDELAREVIQGKWGNGSDRKNRLTAAGYNYSAVQKRVNELLK

SEQ ID NO: 2089 - protein, 296 aa, unidentified
  REGION 1..296: note = Faecalicoccus pleomorphus
MTEQKERKNNMTYTNSKLVSYTKLSPNHSGHRTHSIDRITPHCVVGQCSVETLGNIFAPTSRQASCNYGIGPDGRVGMYVEEKNRSWCSSSNANDQRAVTIECASDTKHPYTMNSTVYATLIKLCVDICKRNGKKKLIWLGDKSKTLNYSPKSDEMVLTVHRWFANKSCPGDWLYSRLGDLASKVTAQLGGSSSGGTTASGLYRVRKSWNDAKSQKGAFKSLDNAKRCAESNPGYFVFDESGRIVGSTTSSTKTVDEIAREVIRGNWGNGAERKNRLTAAGYDYNAVQRKVNELLK

SEQ ID NO: 2090 - protein, 512 aa, unidentified
  REGION 1..512: note = Clostridioides difficile
MKLVESILTKNPCYTAGRKIDVKGLMLHSVGCSQPRASAFINSWNSPTFSRACVHGFIDGNDGTVYQTLPWNHRGWHCGSSINGSGNNTHIGVEMCEPACITYTGGATFKCSDVDTAKAVAERTYRAAVELFAMLCQKFALDPLADGVILSHKEGHSRGIASNHGDPEHLWSQLGMGYTMDTFRKAVKEQMGGKAADTKKGTQASVFAGLSEKDAVPIIGELCREDMKKSGVLASVSAAQFILESGYGKSELGQNANNMFGMKKSLSGNTWADSTWDGTSVYTKKTQEQHTDGTYETITADFRKYPCVEDSVADHSAYLLGAKNGRSLRYKGIKGMTDYKAVAQIIKDGGYATSLTYVEKLCNIIEKWNLTQYDVTDAPAPKPSTPDTVTEFPATPFSVKVIIDDLNYRSEPSMNGKVNGQTGKGTFTIMEVRNGGWGRLKSGAGWIWLSNPTYCTVGKTVTITEDKKKSIDELAKEVIRGDWGNGTERKEKLTAAGHDYAAIQKRVNEMLK

SEQ ID NO: 2091 - protein, 282 aa, Mobiluncus curtisii
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNIFGHRDFSATECPASIAGSQHATYMARAGYWYDQMSSGKASATPAPASKPAPTGCKSIDTLAREVINGSWGNGNDRHQRLTAAGFDYDAVQARVNEILGLKSKPAGKSIETLAREVIRGDWGNGQERYNRLTNTGYNYQQVQNRVNQILG

SEQ ID NO: 2092 - protein, 282 aa, unidentified
  REGION 1..282: note = Varibaculum timonense
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPCWGKNVFGHRDFSATECPASIAGSQHATYMARAGYWYDQMSSGKASATPAPASKPAPTGCKSIDTLAREVINGSWGNGNERYQRLTAAGFNYDAVQARVNEILGLKSKPAGKSIETLAREVIRGDWGNGKERYNRLTNAGYNYQQVQNRVNQILS

SEQ ID NO: 2093 - protein, 269 aa, unidentified
  REGION 1..269: note = Peptoniphilus rhinitidis
MSNSPLVQATILSPNHSGRRNQKITKIAIHHAAGVINGRNLAGIFVPRSRRASANYNLGSDGVIVLGVDESNRAWTTSSSWCDNRAVTIEVGNSTRGPQWLVSDYVLNRLIDLVTDICKRNGIYPCTYTGGKDGVLQKHEWYKSTNCPGPYLGSKFPYIANEVNKRLRGNKTVSKPTSGLYKVRKSWDDPKSQKGAFKNLENTKRCADRFGLKVFDANGKIVYPVGKTIDELAKEVISGKWGNGEERKRRLTNAGYDYYAIQKRVNQLL

SEQ ID NO: 2094 - protein, 115 aa, unidentified
  REGION 1..115: note = Thomasclavelia spiroformis
MQGKYGNGTARKQALGSRYGEVQDFINHISTASAQTLAQEVLAGKYGNGDTRKTVLGSRYNEVQAIVNQCGKKSIDEVAREVIRGEWGNGNARKQKLEAAGYDYEAVQARVNALL

SEQ ID NO: 2095 - protein, 312 aa, unidentified
  REGION 1..312: note = Lactococcus formosensis
MKTKGIDISTWQKPSQINYDQLAKEVDFVILRAGYTGHGTGVSLHKDDAFEQHYKAFHERGIPIGVYWYSCANTNAKGVAEAKKCLEIIKGKTISYPVFIDTEDNYHQRPSGKKAITDALVGFCETVENAGYYAGIYASSSWFQDLTELDRLAPYDFWVAQWSNKEPTLRHGIWQYTSKGKLSGYSGNLDMNYAYKDYKAIIQSAGLNHLAKEESTPAPTEKKSVETLTKEVIQGLWGNGEERKKRLTDAGYDYVAVQSKVNEMLSSKKSIDAIAKEVIRGDWGNGQERKNKLTNAGYDYISVQKRVNELLK

SEQ ID NO: 2096 - protein, 283 aa, unidentified
  REGION 1..283: note = Actinomycetes
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPAWGKNVFGHRDFSATECPASIAGSQHGAYMARAGYWYDQMTSSKTSTPAAAPTSKPAPSGCKSIDTLAHEVINGSWGNGNDRYQRLTAAGFDYDAVQARVNEILGFKAKPAGKSIETLAREVIRGDWGNGQERYNRLTNAGYNYQQVQNRVNQILS

SEQ ID NO: 2097 - protein, 479 aa, Blautia sp.
MTNEEFIKKIAEYVQKYAYVYGITVHSPIIAQAILESGWGKSKLAATYHNYFGLKCGTKWTGKSVNLTTQEEYEPGTITTIKDNFRVYDSMEEGVKGYFEFIQLERYHNLRGITDPKKYLETIKADGYATSSTYVENTMKLVNQYNLTQYDGKEGNGMTEAELRRKPVEYLKQYVGIKEGSVAHKAILAVFNDSGLCSRYKMTIYDAWCATGAGAAMIATGLADIYPCVECSCGYVVEKAQKAGIWVENDAYVPKTGDQVLYDWDDNGVGDNTGWPDHIGVVDYVSGNTIHVIECNISDTVGYRNLAVNGKFIRGFITPNYAKKATSSGGSTPPAPQKSITEVAKEVIAGQWGNGDFRKNNLAAAGYDYNAVQAEVNRILKGQASTPTKSVETVAKEVIAGKWGNGNDRKAKLEAAGYNYDTVQKKVNQLLSSSGGKSIDAIAREVIAGKWGNGNDRKNRLTAAGYDYNAVQKRVNQLL

SEQ ID NO: 2098 - protein, 284 aa, Mobiluncus sp.
MKDWNNLTADQNLLMNKHYTPGRNGRKIDKVIIHHNAGNLTIRGCWDVWQTRQASAHYQVDVNGRIGQLVWDRDTAWHAGNWEANCTSIGIEHANNHVGNPWTISDATLENGAHLVAALCRYYKLGRPAWGKNVFGHKHFAATGCPGEIAGTQNTRYMARAQYWYDHMTSSKAPTPEAKSVSKPVTTSGKSVDELAREVIRGDWGNGNDRYQRLTAAGYDYDTVQARVNQLLGQKPKPAGKSIDTLAREVIRGDWGNGQERYNRLTAAGYNYNTVQARVNQILS

SEQ ID NO: 2099 - protein, 360 aa, Fibrobacter sp.
MIVALHGIDIANHQEGINLYDVPFDFMIAKATEGTGFVDWTCDGYVQAALAQGKGVGVYHFARTGDPIAQADFFVDNIRGYIGKAVLFLDWENAGDYDLNVLAQGPEWVKRWLDRVYELTGVRPMIYMSKSVCREYDWSAVAPDYALWMAQYPNYDETGYQDDPWTDGYGVGAFPGWAIHQYTSSGRLGGYDGLLDLDIFYGDMVAWNKFAGGTGDVKPSQGGSKSVDELAKEVLNGQWGNGDDRKNRLTAAGYDYNAVQNRVNELVGGSNTKSVDELAHEVIDGKWGNGDARRNALNGAGYDYDAVQARVNEFLNSKSVDELAYEVIQGKWGNGNDRKNRLQNAGYDYNAVQARVNELL

SEQ ID NO: 2100 - protein, 312 aa, unidentified
  REGION 1..312: note = unclassified Enterococcus
MKTKGIDISTWQKPSQINYDQLAKEVDFVILRAGYTGHGTGVSLHKDDAFEQHYKAFHERGIPIGVYWYSCANTKAKGIAEAKKCLEIIKGKTISYPVFIDTEDNYHQRPSGKKAITDALVGFCETIENAGYYAGIYASSSWFQDLTELDRLEPYDFWVAQWSSKEPTLRHGIWQYTSKGKLSGYSGNLDMNYAYKDYKAIIQSAGLNHLGKEENIPAPTEKKSVETLAKEVIQGLWGNGEERKKRLTDAGYDYVAVQSKVNEMLSSKKSIDAIAKEVIRGDWGNGQERKNKLTKAGYDYISVQKRVNELLK

SEQ ID NO: 2101 - protein, 344 aa, unidentified
  REGION 1..344: note = Hominiventricola filiformis
MMKGMDISKWQGAVDFAKVAASGIQFVIIREGYRQAVDGKFFEYVNGCRANNIPVKGVYHFSYALNADQARNEAAFCITQVEKAGLGKDTVIFYDFEYDTVKQAKEKGVNLGKNECVAFTKAFCEYVTSHGYKAGIYSNIDYHKNMYTDELISQYIYWLADYTGDPDYPCMFHQYTSKGSVDGIAGNVDLDYFYGDTAQPESPKKSVDEVAQDVVNGKYGNGADRKAALEAAGYNYDEVQAKVNEILGGDTTPKKSVDEIAQEVINGAWGNGQDRKNRIEQAGYDYTAVQNKVNELCGTPKKSIDEIARAVIRGEYGNGADRKNRITAEGYDYAAVQARVNDLM

SEQ ID NO: 2102 - protein, 49 aa, unidentified
  REGION 1..49: note = uncultured Abiotrophia sp.
MTPSDDLITEVAWDVIRGEYGNGEERVRELTEAGYDYQTVQDRVNQLLS

SEQ ID NO: 2103 - protein, 269 aa, unidentified
  REGION 1..269: note = Peptoniphilaceae
MSNSPLVQVRILSPNHSGRRNQKITKIAIHHAAGVINGRNLAGIFVPKSRRASANYNLGSDGVIVLGVDESNRAWTTSSSWCDNRAVTIEVGNSTRGPQWLVSDYVLNRLIDLVTDICRRNGIYPCTYTGGKDGVLQKHEWYKNTNCPGPYLGSKFPYIASEVNKRLRGDKTVSKPTSGLYRVRKSWSDVKSQKGAFRNLDNAKRCADRFRLKVFDANGKIVYPTDKTIDQLAREVISGKWGNGEERKRRLINAGYDYYVIQKRVNELL

SEQ ID NO: 2104 - protein, 269 aa, unidentified
  REGION 1..269: note = Peptoniphilus lacydonensis
MSNSPLVQERILSPNHSGRRNQKITKIAIHHAAGVINGRNLAGIFVPRSRQASANYNLGSDGVIVLGVDESNRAWTTSSSWCDNRAVTIEVGNSTRGSQWLISDYVLNRLIDLVTDICRRNGIYPCTYTGGKDGVLQKHEWYSNTNCPGPYLGSKFPYIAREVNKRLRGNNTISKPTSELYRVRKSWDDPKSQKGAFRNFDNAKRCADRFGMKVFDANGKIVYPVGKTIDQLAREVISGKWGNGEERKRRLTQAGYDYKAVQKIVNSML

SEQ ID NO: 2105 - protein, 299 aa, Gardnerella vaginalis
MSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITSFCSKLETYGYYAGFYTSLSTANNLVSAHVRNRYALWIAQWNTHCSYQGSYGLWQYSSSGSVPGVAGRVDMDYAYVDYPSIIKNVGLNGCKNGGSDQAARTSSIDEVAREVINGAWGNGNERKQRLTSAGYDYASVQNKVNKLLGVKACRKSVDELAREVIRGTWGNGSTRKQRLTSAGYDYDTVQKRVNELL

SEQ ID NO: 2106 - protein, 283 aa, unidentified
  REGION 1..283: note = Actinotignum urinale
MKNWNTLEADLNLLMNKHFTKGRQGRSINKIILHHNDGNLSIQGCWNVWQTRPASAHYQVETSGRIGQLVWDRDTAWHAGNWVANTTSIGIEHADASTHPYRISDACLENGAHLVAALCHYYKLGRPAWGKNVFGHRDFSSTECPASIAGSQHGAYMARAGYWYDQMTSSKTSTPAAAPASKPAPSGCKSIDTLAREVINGSWGNGNDRYQRLTAAGFDYDAVQARVNEILGLKSKPAGKSIETLAREVIRGDWGNGQERYNRLTNAGYNYQQVQNRVNQILS

SEQ ID NO: 2107 - protein, 341 aa, Peptoniphilus harei
MYTLLAFVIADYITGVLRAGVERKLSSAIGFKGIAKKIMIFIVVRIANLCDVNLIKGDGTMIRTAIIFFYIANEGLSIVQARILSPNHSGRRNQKITKIAIHHATGVINGRNIAGVFVPRSRRASAYYNLGSDVVIVLGVDESNRAWTTSSSWCDNRAVTIEVGNSTRGPQWLVSDYILNRLIDLVTDICRRNGIYPCTYTGDKDGVLQKHEWYKNTNCPGPYLGSKFPYIASEVNKRLRGDKTVSNPTSGLYRVRKSWSDVKSQKGAFKNLENAKRCANRFGLKVFDSNGKIVHPVGKTIEELAREVISGKWGNGEERKRRLTNAGYEYKEVQRRVNQLL

SEQ ID NO: 2108 - protein, 286 aa, Anaerostipes caccae
MTYTNSKLVSYTKLSPNHSGHRTHSIDRITPHCVAGQCSVETLGNIFAPTSRQASCNYGIGPDGRVGMYVEEKNRSWCSSSNANDQRAVTIECASDTKHPYTMNSTVYATLIKLCVDICKRNGKKKLIWLGDKSKTLNYSPKSDEMVLTVHRWFANKSCPGDWLYSRLGDLASKVTAQLGGSSSGGTTASGLYRVRKSWNDAKSQKGAFKSLDNAKRCAESNPGYFVFDESGRIVGSTTSSTKTVDEIAREVIRGNWGNGAERKNRLTAAGYDYNAVQRKVNELLK

SEQ ID NO: 2109 - protein, 299 aa, unidentified
  REGION 1..299: note = Clostridium sp. AM32-2
ISLEVYTNFRILPTNSSLVSYTKLSPNHSGQRTHSIDRITPHCVVGQLSCESICGCFTSPSRQASCNYGIGKDGRISLCVEEKNRSWCSSSNANDQRAVTIECASDTKHPYTMNSTVYATLIKLCVDICKRNGKKKLIWLGNKKKTLNYSPKSDEMVLTVHRWFANKSCPGDWLYARLGDVAAKVTAELSGASTSTGTVTATGLYRVRKIWADAKSQKGAFKSLENAKKCAASNPGYSVFDANGNVVSGSNTSTIKTVDELAKEVIKGLWGNDADRRNRLTAAGYDYNAVQRRVNELLK

SEQ ID NO: 2110 - protein, 341 aa, unidentified
  REGION 1..341: note = Aedoeadaptatus acetigenes
MYTLLAFVIADYITGVLRAGVERKLSSAIGFKGIAKKIMIFIVVRIANLCDVNLIKGDGTMIRTAIIFFYIANEGLSIVQARILSPNHSGRRNQKITKIAIHHATGVINGRNIAGVFVPRSRRASAYYNLGSDGVIVLGVDESNRAWTTSSSWCDNRAVTIEVGNSTRGPQWLVSDYILNRLIDLVTDICRRNGIHPCTYTGGKDGVLQKHEWYKNTNCPGPYLGSKFPYIASEVNKRLRGDKIVSNPTSGLYRVRKSWSDVKSQKGAFKNLENAKRCANRFGLKVFDSNGKIVHPVGKIIEELAREVISGKWGNGEERKRRLTNAGYEYKEVQRRVNQLL

SEQ ID NO: 2111 - protein, 269 aa, Peptoniphilus lacrimalis
MSNSPLVQATILSPNHSGRRNQKITKIAIHHAAGVINGRNLAGVFVPKSRRASANYNLGSDGVIVLGIDESNRAWTTSSSWCDNRAVTIEVGNSTKGPQWLVSDYVLNRLIDLVTDICRRNGIYPCTYTGGKDGVLQKHEWYSNTNCPGPYLGSKFPYIANEVNKRLRGNNTISKPTGGVYRVRRSWSEVKSQKGAFKNLENAKRCADRFRLKVFDANGKIVYPVGKTIDELAREVISGKWGNGEERKRRLTNAGYDYYAIQKRVNQLL

SEQ ID NO: 2112 - protein, 212 aa, unidentified
  REGION 1..212: note = uncultured Ruminococcus sp.
MIKKVGALFTADQKKSGILASVSLAQFILESGYGKSELAQKANNCFGMKKSLSGNTWSGSVWDGKSIYTKKTKEQNKDGSYTTITADFRKYPSVEDSIADHSAYLLGAKNGSKKRYAGLKGCKDYKKAAKIIKAGGYATSLTYVDKLCSIIEKWKLTQYDIKSSSSSKKSIDTLAKEVIAGKWGNGEERKQKLTAAGYDYNAVQKRVNEMLS

SEQ ID NO: 2113 - protein, 320 aa, unidentified
  REGION 1..320: note = Eubacteriales bacterium mix99
MAITGIDVSHWQGNIDWSKVKAAGIQFAIIKSGGSDDGFYTDSKWEANYKGAKANGIAVGAYYFVGPKCVNAAAGKADAERFIQLLKGKQLEYPVFMDNEAQPASAKAGITEATIAFCETMEAAGYFVGIYGSTDSGFHERMDDSRLTAYTHWVAQYASKCTYSGSYGIWQHSSSGQVNGISGNVDMDLSYVDYPSAIKNGGFNGYAKGTATGSTPAAPTKKPVDEIASEVIAGKWGNGDDRRNRLTTAGYNYSAVQSKVNEKLGATAKQSAVYYTVKRGDTLSAIASKYGTSVYAIQKLNSSLIKNVNLIQVGWRIRVK

SEQ ID NO: 2114 - protein, 320 aa, unidentified
  REGION 1..320: note = Caudoviricetes sp.
MAYTNSSLVSYTKLSPNHSGKRTHSIDRITPHCVVGQLSAESICGCFTSTSRQASCNYGIGTDGRVSLCVEEKNRSWCSSSSANDQRAVTIECASDKTAPYAMNSKVYDSLVKLCTDICKRNGKKKLLWLGSKSKALNYSPKSDEMVLTVHRWFANKSCPGDWLYSRLDDLAEKVTKNLSGTTTSTTTTTTTTKKDTLYRVQVGAYSVKNNADVQLKKVKATGFDTYMVKVGGLYKIQVGAYSKKENAEAMQKKLKAKGFDSFITTESGSAVTTTSKKSIDTIAREVIRGDWGNGAEREKKLKAAGYDYVAVQKRVNELL

SEQ ID NO: 2115 - protein, 525 aa, unidentified
  REGION 1..525: note = Caudoviricetes sp.
MGKQGIDISKWQGSVDFNKVKADGIQFCIFREGYRRAIDGQFIEYVKGAKAAGIPILGVYHFIYVDGATIAENANACIANMKAAGLDPTNTWIFADLEYDTWTKAGVKVTKALCTQYTKEFLDTLKAAGCKKLGIYSNLDYYKNYYDWAQLSEYRKNLWLADYTGGPDVECVIQQTGSTGKVSGISGNVDMDTLYEESMLSNDGGKEDTKVGVTAQDVLNVMRSWIGYSEANGKYIEILNVYNSHKPLARGYAIKPSDEWCDATVSAAAIKAGAVDLIGTEVGVEKHVDIFKKKGIWIEDGSIKPQAGDIIVFNWDDNTQPNDGWSDHIGYVEQVSGNTITCIEGNMSERVGRRTINVGWGYIRGFARPKYASGGVAPKPNPDKSISEVAQEVIQGAWGNGDARKNALIAAGYDYATVQAEVNRILGGGNAVPKKSVNELAKEVIAGKWGNGDARKTALTNAGYDYSAVQKEVNRIFGDANTKSIDTLAREVIQGKWGNGSERKDRLTKAGYDYNAVQVRVNQLL

SEQ ID NO: 2116 - protein, 404 aa, unidentified
  REGION 1..404: note = Caudoviricetes sp.
MNNINWIVRFKNKAFWVALIPAILLLIQVVAAVFGFTLDLGDLGNKLLDVVNALFAVLTILGIVVDPTTAGTGDSEQAMTYTEPKKKGWYKMSNSSLVSYTLLSPNHSGKRTHSIDRITPHCVVGQLSAASICGCFTSPDCEASCNYGIGKDGQIALCVDEGNRSWCSSSDANDQRAVTIECASDKEHPYAMTDAVYQSLIKLCVDICRRNEKNKLLWFGDKDKTLAYEPKAGEMVLTVHRWFANKACPGDWLYSRLGDLAAKVTAQLGSGASTPSTDGTLYRVQAGAFKNKENADRQLEKIKAAGFDTYMVQAGGYYKIQVGAYSVKANAENMLAKVKAAGFDAFITTEQGQAVSSTPAKKSIDEIAREVIRGDWGNGQDRKDRLTAAGYDYDAVQARVNQLL

SEQ ID NO: 2117 - protein, 213 aa, unidentified
  REGION 1..213: note = Clostridium asparagiforme DSM 15981
MTDAVYQSLIKLCVDICRRNGKNKLLWFGDKDKTLAYEPKAGEMVLTVHRWFANKACPGDWLYSRLGDLAAKVTAQLSSGASTPSTDGTLYRVQAGAFKNKENADRQLEKIKAAGFDTYMVQAGGYYKIQVGAYSVKANAENMLAKVKAAGFDAFITTEQGQAVSSTPAKKSIDEIAREVIRGDWGNGRDRKNRLTAAGYDYDAVQARVNQLL

SEQ ID NO: 2118 - protein, 55 aa, Streptococcus sp.
NYTETGLRANNQNIDSIAAEVIQGDWGNGEERKERLEQAGYDYDVVQARVNEMLE

SEQ ID NO: 2119 - protein, 192 aa, unidentified
  REGION 1..192: note = Erysipelotrichaceae bacterium
MGLFDAFKKKTDDVKEEVKTEAVQAKKDIETLAKEVMNGDWGKTDDEIKAKLEAAGYDNFLHVKSKVNNLIKAAEDAKKAAEAAAKEAAAKIEAERLAKRAAKIEELAREVIQGKWGNGQERKDKLTAAGYDYSEVQGKVNELLTTEKEKIEAIAKEVIRGKWGNGQERKDRLTAAGYDYSAVQAKVNELLK

SEQ ID NO: 2120 - protein, 248 aa, unidentified
  REGION 1..248: note = Clostridia bacterium
AGHGINTSGKRCLKSIDANETREWVLNSRICRKIEEKLSGYSGYSLIRLDDTSGNRDIPLKQRTDKANNFGADFYLSIHHNAGINGRSGGGVIAIVYKSIKDGSPTYEWQKALYNSVIDKTGLKGNRAVPLQKQNLHEVRESNMPAVILECGFMDSTTDTPIILSEDFADKVASACVEVLVKKGGLTYKSQTVKNDTPIKKSVEDVAREVIRGLYGNGNERKQRLSALGYSYSEVQGRVNEILRGKRV

SEQ ID NO: 2121 - protein, 255 aa, Solobacterium sp.
MSKTESAIQWMENHAKDNSHGYDQRYRWGERGDYDCSSAVISAWQAAGVPVKSKGATYTGNMLSVFLACGFSDVTRTVNLATGAGLQRGDVLLNTTHHTAMYCGNGKEVEASINEKGTAVGGAPGDQTGREFLIRPYRNYPWNHVLRYRESAAASAKSVTEVAKEVIAGKWGNGSERRRRLTASGYDAATVQAKVNELLHIQGRPQAVYYTVRSGDTLSAIAQKYGTTASAIQKLNPALIRNVNRIHVGWKIRVK

SEQ ID NO: 2122 - protein, 263 aa, unidentified
  REGION 1..263: note = Clostridia bacterium
MLKIALNAGHGINTAGKRCLKAIDKNETREWTLNSRICNLIEAGLKEYDGYELIRLDDKTGKTDVPLKQRTDKANKFGADFYLSIHHNAGVNGKSGGGIIAIVYKSIKDGTVTSRWQKSLYDEIIKTTGLKGNRSVPLQKQDLHEVRESNMPAVLLECGFMDSTVDTPIILTEDYAKKVANGVVTAIVKMGNLKKKTAVAANNVTKVPDTKSQKPKAAKKTVEELAREVIRGLWGNGNERKQRLGNAGYSYKEVQARVNEILK

SEQ ID NO: 2123 - protein, 274 aa, unidentified
  REGION 1..274: note = Oscillospiraceae bacterium
MSKFTPRKTAPSATDKHWIKSTCGGLNECLKISGNSCLPNCVGYAWGRFYELTGEKPRLSTGNAENWYDNTADGYKRSATPKLGAVACWRKGKAFNESDGCGHVAIVEEIKPNGDIVCSNSAYGGTRFYMKTYSKSAGYNDGALTFQGFILPPVDFEEPFAPAKSIDEIANEVIRGDWSNGKEREMRLRNAGYDYDAVQAKVNEILSVPSKTTSIKVGDVVMVKQGAKTYDGGNLADFVYTRPHKVTELVRDRAVIFYDGIVVAAVNVKDLELW

SEQ ID NO: 2124 - protein, 292 aa, unidentified
  REGION 1..292: note = Oscillospiraceae bacterium
MSYMVNINPLNPVFSNGRHRITYGFMVAEYGRAHNGTDLVPGSVGVNSGIIAIGGGVVESVKDTVRITLPLTPQSNWSHPDVLGNIVRIRHNNRFVSRYCHLAFGSIRVKPGDRVEKGQIIAAIGNTGLSTAPHLHFEVWDNGNRINPEPFLMGATSFGQSVGVNSPSATPKAANYSSTQNNIDQIARRVIAGEFGNAPERFERLAVAGYDSKVIQGRVNDILSGDSTAANLASVPARKPIIEPTVKSLETLAKEVIRGDWGNGDERMKRLNAAGYDARTVQARVNEILRKK

SEQ ID NO: 2125 - protein, 313 aa, unidentified
  REGION 1..313: note = Enterocloster asparagiformis
MSNSSLVSYTLLSPNHSGKRTHSIDRITPHCVVGQLSAASICGCFTSPDREASCNYGIGKDGQIALCVDEGNRSWCSSSNANDQRAVTIECASDKEHPYAMTDAVYQSLIKLCVDICRRNGKNKLLWFGDKDKTLAYEPKAGEMVLTVHRWFANKACPGDWLYSRLGDLAAKVTAQLSSGASTPSTDGTLYRVQAGAFKNKENADRQLEKIKAAGFDTYMVQAGGYYKIQVGAYSVKANAENMLAKVKAAGFDAFITTEQGQAVSSTPAKKSIDEIAREVIRGDWGNGRDRKNRLTAAGYDYDAVQARVNQLL

SEQ ID NO: 2126 - protein, 339 aa, unidentified
  REGION 1..339: note = Dorea phocaeensis
MSNSKLVSYTKLSPNHSGHRTHAIDRITPHCVVGQCSVETLGNIFAPASREASSNYGIGVDGRIAMYVEEKNRSWCSSSNANDQRAVTIECASDTYEPYAMNSKVYDSLVNLCTDICRRNGKNKLLWLGDKNRTLNYSPKSNEMVLTVHRWFANKSCPGNWLYARLGDLANKVTANLQGVPVKPSPSPSKSIDAIAREVIRGGWGNGADRKARLESAGYNYSAVQERVNELLYGSNAPSPSPSKSVDAIAREVIRGDWGNGADRKTRLESAGYSYSAVQERVNEILYGSNTSAPSKSIDTIAREVIRGDWGNGQDRKNRLTAAGYSYHEVQKRVNEILK

SEQ ID NO: 2127 - protein, 290 aa, unidentified
  REGION 1..290: note = Longibaculum muris
MGYTNSSMVSYTKLSPNHSGQRTHSIDRITPHCVVGQCSVETLGNVFYPTSRQASCQYGIGVDGRVGMYCEEKNRSWCSSSNANDQRAVTIECASDTYSPYAMNSKVYDTLIKLCIDICKRNGKKKLIWLGDKDKTLNYTPKSDEMVITVHRWFANKSCPGDWLYSRLGDLAAKVTAGLGASDNTPAPQTPSKKVYYRVRKSWNDAKSQKGAFTVLANAKKCADSNKGYYVFDENGKTIYPVQNAKKTVDELAREVINGKWGNGTERKNRLTNAGYDYYAVQKRVNEILS

SEQ ID NO: 2128 - protein, 281 aa, unidentified
  REGION 1..281: note = Erysipelothrix anatis
MLHFTEYAQQVGLTVKQNFTGKVSSVYGSTRASSYAHRKPIEMVVIHTTANTAPAVNEAANLANNNGTNSFNAVADANEVYETVRFSDVSHHAGDKDINQRSIGVELVESNIEQGYINLVKYLGYAMVQLGLYPSTKTVRLHGEFVHTSCGSFYMRKGMNNIVRDIIKYYNIALNGTSQEVNPTPKPEPVVKSNEQIAAEVMRGDWGNGDDRYNRLTNAGYDYYAIQDIINGGVTPTKSIDDVAHAVIRGDYGNGQARYDKLRAEGYDADEVQSRVNEILG

SEQ ID NO: 2129 - protein, 299 aa, unidentified
  REGION 1..299: note = Clostridium sp. AM32-2
MSLEVYTNFRILPTNSSLVSYTKLSPNHSGQRTHSIDRITPHCVVGQLSCESICGCFTSPSRQASCNYGIGKDGRISLCVEEKNRSWCSSSNANDQRAVTIECASDTKHPYTMNSTVYATLIKLCVDICKRNGKKKLIWLGNKKKTLNYSPKSDEMVLTVHRWFANKSCPGDWLYARLGDVAAKVTAELSGASTSTGTVTATGLYRVRKIWADAKSQKGAFKSLENAKKCAASNPGYSVFDANGNVVSGSNTSTIKTVDELAKEVIKGLWGNDADRRNRLTAAGYDYNAVQRRVNELLK

SEQ ID NO: 2130 - protein, 308 aa, unidentified
  REGION 1..308: note = Caproicibacterium sp. BJN0003
MNLHKLLLTNNACYKAGRTITPRGIMVHSTGANNPNLKRYVGPDDGLLGKNQYNNHWNTDKPGGRQVCVHAFIGKLADGTIAAYQTLPWNMRGWHCGSGFQGSGNDTHISFEICEDNLTDAAYFNAVYKEAVELCVYLCRQYGIRPERPYLICHSEGHELGIASNHGDVMHWFPKFGKSMDTFRAEVKRLLENGGSGTSSSSGSKSVDELAREVIRGDWGNGAERKTRLTAAGHDYAAVQAKVNEILSGKSTSTTATYETYTVVKGDTLWGIASKKLGSGTRYKEIKTLNGLSLDTIYAGQKLKMPKK

SEQ ID NO: 2131 - protein, 226 aa, Abiotrophia defectiva
MKPQIQELLTKAQAYLGVQGGSPAHQALIDAYNAVEPLPVGYAVTYSDDWCDVFVTVMGDQAGIAHLIGRECGVPRHLTWCQEQGIWLGHVWPQAGDLIFFDFGGGPTSHIGIVESVDGDSETVNTIEGNWLNQVVRRHYASDDWRILGYARPHYDARAGSVTNGNEARGANHPNSCVDAVSDLDEVAWSVIRGDWGNGQERVERLTDAGYDAQVVQELVNEKLAS

SEQ ID NO: 2132 - protein, 339 aa, unidentified
  REGION 1..339: note = Enterocloster clostridioformis
MGYTNSPLVYYTRLSPNHSGQRTHSIDRITPHCVVGQLSAESICACFPAGREASCNYGIGTDGRVSLCVEEKNRSWCSSSNSNDQRAVTIECASDRTEPYAMNSKVYDSLVRLCTDICRRNDKKKLLWFANKNQTLNYNPKPDEMVLTVHRWFANKSCPGNWLYARLGDLAAKVTAALGSSQQTPSANDFCWYRVRKTWPDAKSQKGAFHSLANAKKCADSNAGYKVFDESGNAVYSAAGVSSVPKSMDAIAKEVIRGDWGNGAERKQRLNAAGYDYESVQKRVNEILVGTSTPSKTIDEIAREVIQGKWGNGAERRQRLTAADYNYSVIQNRVNEMLK

SEQ ID NO: 2133 - protein, 327 aa, unidentified
  REGION 1..327: note = Caudoviricetes sp.
MGYSALTNVAIMSPNHSGSRYNSISKITIHHMAGNLSIETCGNVFLNSNRQASSNYGIGSDGRIACYVDEENHPWTSANWDNDDRAITIEVANSETGGDWPISQAAYASLIRLCADICNRYGIYPYYDGTPSATLTEHCMFVATNCPGPTIHSMQVNHVIENDIRTAMAGGAVTPQPTPAVSGDVEDLALRAIAGEFGNGDARRAALGSMYEAVQSRINEMYGGIQSIPTYSLDDVARRVITGEFGNGQDRINSLAAAGYDNVAVQQRVNEILQGVTSSPQDDLSSIAEAVYRGNYGNGQDRINALRAAGYDPDAVQRAVDQIYYGL

SEQ ID NO: 2134 - protein, 241 aa, unidentified
  REGION 1..241: note = Caudoviricetes sp.
MIRPDYRDIRIRSQFLQHSSKGSEWEEHKYIKRINGTYYYPDSYEGGRHLPKGSKFGEYTKGDPDFDEKNFDEKNRLGDTDFFGFKREDGTYVILEEDMKWELPLGTEITPELIDRLEEFGQKISEMQEKGERFTNEDWTKWAKDAIDGDEDSSDGAKNLTENDVENLAKEVIRGNFGNGQERKDLLGENYEEIQKRVNELMKGSAGSKTIPSDKTKAIGIAEEAAKRAVSLVNAYRNKTK

SEQ ID NO: 2135 - protein, 218 aa, unidentified
  REGION 1..218: note = Caudoviricetes sp.
MTHKEFIEVIAKYVIKYASDYGIKVHSPIIAQAILESGWGGNTLASKYNNFFGLKCGGSWKGKSVNMATKEEYTVGTLTDIRANFRVFDSIEDGVKGYFEFINYSRYSNLKGVTNPEEYCRLIKADGYATSSTYVTNLMRVIRDNNLTRFDGTQENVEKEKEDMVSGDIVGTQLTGAEIIELLAKEVIKGRYGNGSERKQKLGELYPIIQKRVNELCK

SEQ ID NO: 2136 - protein, 403 aa, unidentified
  REGION 1..403: note = Caudoviricetes sp.
MSYSDLTNVYIPSPNHSGTRQNYVSKITIHHMAGNLSVESCGGVFQNTAREASSNYGIGSDGRIGCYVDEENRAWTSASWWNDNQAITIEVANNEIGGNWGISDAAYNALIALCADICNRYGINPYYDGTIYAPLTEHMMFASTNCPGPTIHALLANGTIENDIRAAMNGGYAPSTPTPSAPSADVSGDVEDLARRTIAGEFGNGDQRRAALGSRYDEVQARINEIYGGVTQSAAPSYSIDDIAQRVIAGEFGNGSDRVANLAAAGYDNVAVQNRVNELLGGGYSAPTTPTDLGAVVDAVLRGEYGNGSDRADALAAAGYDYNEVQAAVNARLGAGTGAVSYNDTISVGDTVVVTNPVIYGSNSTFAVNYDYYTVMEVVGDRAVIGVDGVVTSAIATYNLRKV

SEQ ID NO: 2137 - protein, 495 aa, unidentified
  REGION 1..495: note = Caudoviricetes sp.
MCRSAGRSILRSRMRRTTSTPRIMLLGAMVSARSCTVRYSPRTRRPAPTMGRTTNNSKEINSMVAYGKWRRWRSGLAAVVMVPVLALTPSVAFADAGVDTSQWQGCITSARAQQAKANGVSFAFVKATEGAGGWRDSKFDCSARGFAAAGVRLGAYHFARPDLNRGTAGALAEADSFVNATRQWIGRGVIPVLDWEPGGHWTRQTWWAKTWLDRVAAAYKTKPLLYISASIVKEADWSAVAAADYGLWLAGYPRGFKGERLRNPGPVPYSVSPWKFAAAWQYSSTGNVPGIGSAVDVNWFYGDAVTWAKYANSPLPSAPSPSVPVKPSTPATGAPVGDVETLARAVIRGDYGNNPQRRMLLGSRYGEVMARVNQIMSSPRVPSSGGGKSITHVVRWGETISGLAARYHAYPLSAWRVPSGNINVVYPGNVVTYRAGTSRPGSSRPGGNVTRRTVTVRPGDSLTGIAARLGIPWTRLTGYRSGNPSLIYPGERLYY

SEQ ID NO: 2138 - protein, 495 aa, unidentified
  REGION 1..495: note = Caudoviricetes sp.
MCRSAGRSILRLRMRRTTSTPPIMLLGAMVSARSCTVRYSPRTRRPAPTTGRTTNNSKEINSMVAYGKWRRWRAGLAAVVMVPVLALTPSVAFADAGVDTSQWQGCITSARAQQAKASGVSFAFVKATEGAGGWRDSKFDCSARGFAAAGVRLGAYHFARPDLNRGTAGAIAEADSFINATRQWIGRGVIPVLDWEPGGHWTSQTWWAKTWLDRVAAAYKTKPLLYISASIVREADWSAVAAADYGLWLAGYPRGFKGDRLRNPGPVPYSVSPWKFAAAWQYSSTGNVPGVGSAVDVNWFYGDAVTWAKYANSPLPSAPSPSVPVKPSTPATGAPVGDVESLARAVIRGDYGNNPQRRMLLGSRYGEVMARVNQIMSSPRVPSSGGGKSITHVVRWGETISGLAARYHAYPLSAWRVPSGDINVVYPGNVVTYRAGTSRPGSSRPGGNVTRRTVTVRPGDSLTGIAARLGIPWTRLTGYRSGNPSLIYPGERLYY

SEQ ID NO: 2139 - protein, 403 aa, unidentified
  REGION 1..403: note = Caudoviricetes sp.
MSYSDLTNVYIPSPNHSGTRQNYVSKITIHHMAGNLSVESCGGVFQNTAREASSNYGIGSDGRIGCYVDEENRAWTSASWWNDNQAITIEVANNEIGGNWGISDAAYNALIALCADICNRYGINPYYDGTIYAPLTEHMMFASTNCPGPTIHALLANGTIENDIRAAMNGGYAPSAPTPSAPSADVSGDVEDLARRTIAGEFGNGDQRRAALGSRYDEVQARINEIYGGVTQSAAPSYSIDNIAQRVIAGEFGNGSDRVANLAAAGYDNVAVQNRVNELLGGGYSAPAAPTDLGTVVDAVLRGEYGNGSDRADALAAAGYDYNEVQAAVNARLGAGTGAVSYNDTISVGDTVVVTNPVIYGSNSTFAVNYDYYTVMEVVGDRAVIGVDGVVTSAIATYNLRKV

SEQ ID NO: 2140 - protein, 208 aa, unidentified
  REGION 1..208: note = Caudoviricetes sp.
MIRPDYRNFRARSQSFQHSSEGSSWKKHKYIKRVDGTYYYPDSYEGGRHLPDGEKEKSMEDELFEKLKNSSDKDIGQMLRGSFDKVLLEQMGVDWTKLPKEEVDRMQRSLIDRLEEKTESNSKIDLSENDVENLAKEVIRGNFGNGQERKDLLGENYEEIQKRVNELMKGSAGSKTIPSDKTKDISIAEEAAKRAVDLVEADRNKKTK

SEQ ID NO: 2141 - protein, 328 aa, unidentified
  REGION 1..328: note = Caudoviricetes sp.
MGYSALTNAAIMSPNHSGSRYNSISKITIHHMAGNLSIETCGNVFLNPNRQASSNYGIGSDGRIACYVDEENHPWTSANWENDDRAITIEVANSESGGDWPISQAAYASLIRLCADICNRYGIYPYYDGTPSATLTEHCMFVATNCPGPTIHAMQVNHVIENDIRAAMAGAAVSAPQATQPVGGDVEDLARRAIAGEFGNGDARRAALGSMYEAVQARINEIYGGIQTTPTYSLDDVASRVIAGEFGNGVDRINALASAGYDNVAVQQRVNEILQGTPSSTQGDMSAIAEAVYRGDYGNGQDRINALRAAGYDPDEIQRAVDQIYYGL

SEQ ID NO: 2142 - protein, 248 aa, unidentified
  REGION 1..248: note = Bacteroidales bacterium
MAKQEKDRFSLNKGGNRRFDIHKGSSRKFDLSKDDIEEVTSPEATVTPKPDEVVFAPNPPQPMEPASVNPVKKQGSVEIPIEEATPAPKKSKVWLWALIGIAVVLAFIGMAMLNKTNKDEASVDSQVENTVVNNDSIGEDVTDPVDNQESTSAEVANEQKVTSSESSTPDVNTGVVEIPVSQAGSEATATNAIRSVPTVTGVSNDIEVEALNVIKGTYGDGNERKSRLGVRYAEIQNRVNELKRAGKF

SEQ ID NO: 2143 - protein, 166 aa, Bacteroides sp.
MAKEKLFTSEDFDKEPKTPKKGHIKWIIIAAIGILAILAIIFGLKGCNSDNQSQSTEISSTSVYEMQDSVVAIKVVEDVDSIVDGTYHDKESFDEQTTDKSTISIESPEKIAEPASNTDGVSNVETEALKVIRGDYGNNPERRKILGINYQSIQNRVNELKRQGAF

SEQ ID NO: 2144 - protein, 186 aa, Bacteroides sp.
MANSDVKLKHKVQLRKKVEEPEVLIDSEPTPTPNEPKSKTWLWILLGVIVLGVIGYMLFSKSGEKAVETSEQEIEAVAEPSVLTDTTIVEEAEQEEIVPENNNDVANNSETQSSNAVETPATVDNTSNVSPSTSANVSSVSNDVEAEAMKVIRGDYGIGQERKDKLGSKYQTIQSRVNELKREGIF

SEQ ID NO: 2145 - protein, 252 aa, Bacteroides sp.
MANKGNFNFEKGGSGSSPDKDGNGKINLNKETPKELENGIEVDAYGNPVHPIRTPQPEEPASVTEPNLSEEAIKAEIENGPEEPRKKGYAWLWALIGIAIVLAFLGMLFLNRGSKEEGADTIQSETVLSSADSVATADDSAVAVVSEAVASDSQNSNVVDQAVAAGSEVAANVAETATKAADAAASKATETAAKVTETASNAASSVSGSIESEALNAIRGEYGNGIVRKEKLGTSYSEVQSRVNEMKRAGKF

SEQ ID NO: 2146 - protein, 272 aa, Bacteroides sp.
MAKQDKSKFQLNKGTDHKFDISKGNKRKFDLTKDADEPMAAAPKIGTPDVAPQASVPKPAPAASKPKSVSEPVIANKPEPSAAPISVLPEFEKEKRNNGKWLWIILVILIVILVLWWLFMNKTSEPQPEADAEVTEQITVPTDETIENPTDEVTAEPGDATTSESALPTEATENTAQGQDAGQTDPVTTTSAQAESTPAPATSTSSATAANSAAVTAGNSTSASNVSNDIEAEAMKVIRGVYGDGQTRKQKLGERYTAIQKRVNEMKREGLF

SEQ ID NO: 2147 - protein, 241 aa, unidentified
  REGION 1..241: note = Prevotellaceae bacterium
MVQLKRKVTLRTKETVEQEPQPATLQKDPKPSSGQGKWWIAMAVVLLLVGLGVYSYRHNASTAEKAVAEAAVGSTQGVDTAQTTSKAGESNEASAPAQSAANQVQTKGAEAGQASATAQGAAPAAVKAGASETPASVAQTSAKAATPTAKEAAAQQTAAGKPSTMPQTAKSASAQATQMPAAVQPAAATSMEALKGSVEQVAHEVIRGEFGNGRERMDKLGARYTEVQRRVNQIYRAHRAR

SEQ ID NO: 2148 - protein, 221 aa, unidentified
  REGION 1..221: note = Bacteroidales bacterium
MATLKKKVTLRTKVADELANITPEIPVPNPENKRNGKGKWFGIAAVLVIVVAVVFFLLKPEKTDDTFIASDDVVHQQDVVTDVQQQENVDTEQTVPELVVEDRTIEENDNSDNVPNVVADVQVESVITNDTQKENNVSDKNNETDNSNTTISQQNNTLSTTESKTILPKESNLTAETIEAKAWLVIRGDFGNGKERKMKLGSDYSVIQNKVNELYKNGLVH

SEQ ID NO: 2149 - protein, 234 aa, unidentified
  REGION 1..234: note = Bacteroidales bacterium
MVELKRKVTLKTKSAASEEDAAEKVHLKKKVTIKEKHAEEELPTSGNDGGNEGNPTPTPDYPKGRKWILWLIIIVALAIIGYLWHSHSGSSEQGDGNLGDSTKVENTDSTKSQSSDSIATADSSKAEASVGSGGKISTEAESATSPKGYGNAETRESAIAPQKQQEPNKLSSDVSGDSKPKLETNVPLGTVEETANEVIRGLYGNGNVRKNKLGSRYHEIQDRVNEMYRQGLVN

SEQ ID NO: 2150 - protein, 201 aa, unidentified
  REGION 1..201: note = Mollicutes bacterium
MIRPDYRDFRTRSQSFRHSSEGSSWKEHKYIKRVDGTYYYPDSYEGGRHLPDGEKEKSMEDELFEKLKNSSDKDVGKMLRGSFDKVLLEQMGVDWTKLPKEEVDRMQRSLIDRLEKKTESNSKIDLSKNDVEKLAKEVIRGNFGNGQERKDLLGGNYEEIQKRVNELMNGSAGSKTIPSDKTKAIGVAEEAAKKSRRFGRG

SEQ ID NO: 2151 - protein, 243 aa, Prevotella sp.
MAKDKKSTRSFDLEKGGKRSFELEKKSTRSFDLKKDEEEVAVPITPGATDVPKNKQEKAAIKSAEVPQSSTTPMSNGNGYDRDSKKQWLWISLIIAVLAALAYFFILGGRPEASDTDVIPTEIAGSDSYATNAESSTPADSVEEAASSEIANDETAQAGLVPENVVLEARHPSNTDTHVASQQSEKTAPVTARLSTGSFSSADVDNQARQVIKGVYGNNPERRQKLGVDYEAIQKRVNELMRR

SEQ ID NO: 2152 - protein, 191 aa, unidentified
  REGION 1..191: note = Muribaculaceae bacterium
MANSDVKLKHKVQLRKKIEEPEVLGNNGSIEPGPTPTPNEPKSKTWLWILLGVIVLGVIGYMLFSKSGDKAVETSEQEIKAVAEHSVLTDTTIVEEAEQEEIVSENNNDVANNPETQSSNAVETPATVDNTSNVSPSTSANVPSVSNDVEAEAMKVIRGDYGIGQERKDKLGSKYQTIQSRVNELKREGIF

SEQ ID NO: 2153 - protein, 369 aa, unidentified
  REGION 1..369: note = Bacteroidales bacterium
MADNKFNLSKGEEKKDRFNIPKEIKLQALKKSILADGVIDAEEVKQLREVLYSDGKIDKKGADFLFELNNAVSSKSNHESWKTLFVEAISTFLLEDEQSPGEIDTDEAKWLLSKIQGDGRLDKTEKALLDNIKNKAKEIPPVLKPLFSETKKSKWWLWLLLVVVAIVVIIICVKNCSSNGTNKIVTEKTEQVNAKVAEITSELQNPNVNFDEAEAKIVAAQEAIDVANANATTEEEKQAVAEAQAKVEAVAQAVEAAKQAAESVPQTPTEPVSPEAEETISQVASEHPATKPAELTKPATSPSQNSQPATVKPVTSASTTSSATLPKGTIEEKAKRVIRGDYGNGAERKQALGSEYREIQSKVNEIINH

SEQ ID NO: 2154 - protein, 103 aa, unidentified
  REGION 1..103: note = Bacteroidales bacterium
STPVVEEDKSNKEAGDNNKPTTTSEQEGKTQTTSETTNQTKDVASETTQKKEAIPVGSSIEEKAKLVIRGDFGNGEERKMKLGSEYSAIQNKVNEMYAKGLVY

SEQ ID NO: 2155 - protein, 414 aa, unidentified
  REGION 1..414: note = Bifidobacterium polysaccharolyticum
MRWSHARHARAKPRYARIMVGALAALAMLSPGVAYADAGFDNASYQGCYNAQAAKASGASFSITKITEGTGYVNPAANCQLAANKAADLRIGAYGYARPEYGNSPEAEADFFNAQSNARGLVHAGVIPFLDWEPPAKYRGDTQWAKRWLDRVASYWGTKPIIYMSASTISAGDWTAVAGADYGLWVAGYPRGYTGERLRDPGAPPYSVAPWHFAAAWQYSSSGHVPGVGTAVDVNWFYGDALTWAKYANAPVGTQPNPVAPSPTPKQGAPVGDAASIATAVIRGEYGNDPQRHALLGNRYDEVMAVVNERLRGNSGGGNGSGTYVVRPGDSLSAVFGGSWPMVARLNGIQAPYVIHPGQRLATGNGGGGGRTVTVQRGDTLSGIAARLGIPQSQLHGYRSGNPNKIQVGEVLHY

SEQ ID NO: 2156 - protein, 173 aa, unidentified
  REGION 1..173: note = Bacteroidales bacterium
MAKEKLFTPEDFDKPKPKKNKLLKTILLGLGILCVIGLCIWLIISITSDSDKTTGSEMTSVQTRQESLTTLENIDNPDSISKENLEEVKDPTSEQTNEIEEESIQSSQSPGATSNTVLTSPASDHTISNNVETEALKVIRGIYGNVPERKERLGAQYPAIQARVNEMKRQGIF

SEQ ID NO: 2157 - protein, 209 aa, unidentified
  REGION 1..209: note = Muribaculum sp.
MATEKSKFQLKKGGDHNFDISKGGKRKFDLTKDEDDVVVTANTSSPADVSEPTSVHPDAEPNGNKKWLWIALAIIVIAIIAWLLIPSTKSTSEDTISAEETEVVTSANETDELNSEVTPATDETTDENEEVATADDSYSSDEQTPQGSNTDSAPTVPENANNVSEDVEKEALKVIRGDYGIGQERVNNLGSKYHAIQSRVNELKRQGAF

SEQ ID NO: 2158 - protein, 247 aa, unidentified
  REGION 1..247: note = Muribaculaceae bacterium
MAKKNNDRFELNKGGSRKFDLEKGTGKHRFDLSKDDELIDEENVGAGVQPGEPVEGDGSVKPVIPVEGVNPPQPEVPASVLEPDLSEEATDKAIEFGPEEPKKKGFAWLWALIGIAIVLAFLGWTFLKKGDKTDANAPEQTEEAVAVVDSANDDSIAALPSEGTSDEAVASVAGNSDNGAENGAEGGSAVENSVAPSASTSGSDVETEAMKVIRGEYGNNPVRRNNLGSKYQEIQNRVNELKRTGKF

SEQ ID NO: 2159 - protein, 468 aa, unidentified
  REGION 1..468: note = Bacteroidales bacterium
MPIKERILNFPLESIRPYLPTPQGSIEYDERLSPRAPIMSYVPAAAEVLIPNNLEGSFQDDKAKSLLSGSPRSFSGAFDARDKLKDTRLKIKNYDENNYHSPLVDRYSFVHPKSSIWARLTSRTDPNAKTIYRKIDDATRPKDLIGYDAVLVAASPNATEKNIASFFPDGMYGTKNVIDTELEPDWNFRLKESEIGNDNYRIAESDYNNKRMHDLDEGLRYIFNDVGIGNDTLIRAGITGGYDGLDLGTAEVLLGIQDNTNLSKDEKIAIQNALDLFYGQMNTAQTQDVIADRVKQGAANHNQYYNPQIALEESYKDSQGNIVWRPSTRKYSNGGRLNTSHSFAHGGSMSRKAAEATRGNARLVKKREEDNDDAYFQDTPRGGSDIDTLAVRVMRGDLGTGEQLRRNLGTKYQAVQRRVKQLRASQGGMMGDDVDEFADDELSENAFANGGRLSRITRPNDKRYEIYF

SEQ ID NO: 2160 - protein, 191 aa, unidentified
  REGION 1..191: note = Muribaculaceae bacterium Isolate-104 (HZI)
MANSDVKLKHKVQLRKKVEEEPQPVVAPKPESTPTLEPENSKSNKWIWWVVGVIVLCIIGYFLFSKSEKEQPAQTETEVVEEVSAVESVDEATDQPEGVQDEANSEEASEATQTEQPAAEPKAEAPVTNVVTEQTQPKATESASVSNDVEAEAIKVIRGEYGIGQERKDKLGAKYQPIQNRVNELKREGVF

SEQ ID NO: 2161 - protein, 328 aa, unidentified
  REGION 1..328: note = uncultured Solobacterium sp.
MGYSALTNAVIMSPNHSGSRYNSISKITIHHMAGNLSIETCGNVFLNPNRQASSNYGIDSDGRIACYVDEENHPWTSANWENDDRAITIEVANSETGGDWPISQEAYASLIRLCADICNRYEIYPYYDGTPSATLTEHCMFVATNCPGPTIHAMQVNHVIENDIRAAMAGAAVSAPQATQPVGGDVEDLARRAIAGEFGNGDARRAALGSMYEAVQARINEIYGGIQTTPTYSLDDVASRVIAGEFGNGVDRINALASAGYDNVAVQQRVNEIIQGAPSSTQGDMSAIAEAVYRGDYGNGQDRINALRAAGYDPDEVQREVDRIYYGL

SEQ ID NO: 2162 - protein, 199 aa, Bacteroides intestinalis
MRRLMANSDVKLKHNVQLRKKVEEEPQPVVAPKPEPTPTPTPEPENTKSNRWIWWVVGVIILCIIGYFLFSKSGKEQPAQPETEVIEEVSAIEGVDEATDQPEVVQDEANAEEAFKASQTEQPAEDPKAGAQAPVTNVVPEQTQQKATESTSISNDVEAEAMKVIRGEYGIGQERKDKLGAKYQPIQNRVNELKREGVF

SEQ ID NO: 2163 - protein, 201 aa, unidentified
  REGION 1..201: note = Segatella copri
MVDNKKQRKSTRNFNMEKHVERHFDIEKEEAPVVAEVSGGKSADAKPRVTAGGDNSNGSKNKMLALVAIVVLAIVAFVAYRSCGSNENTVEEPTNTVVSDSTEKEKTDTTSTVETTNSESGQPQSTVSEGSSETEAKPEPNSVSNEPISTNASTENTVEEKAKQVWDGVYGNGTERKSKLGSDYKAVQKRVNEMYRNGYRH

SEQ ID NO: 2164 - protein, 369 aa, unidentified
  REGION 1..369: note = Siphoviridae sp. ctUse40
MEENKNLTVEEIISRIEQAPKEVQVMVAKAFLRDDIPNEDIQYKFNTDTIEELNDPNEESNVENINVELPEGIGADGFTMRTSKPSNNPNYITTGAGGLSTCIKGYPTDANANVYANCVGHAHGRRNEIINTIRGTNKNNNPTLNCNAENWIERAKAAGMTVGQTPRVGAIGVAMKGATLNGIDGAGHVWVVERVNSDGSTYTSESGYGGKAFWNQTRSNSNGRWGLSSGYTFRGFIYLPADVQNKIGSDSSQPSSNIANKSVDELAREVIAGKYGNGQDRVNALGSRYNEVQVRVNQILAGNKPSQPSTPSQPSGDDLLTLVKKTIRGDFGNGQARRNALGSRYDEVQAQVNKNINAGLTRWDNIRLF

SEQ ID NO: 2165 - protein, 616 aa, unidentified
  REGION 1..616: note = Caudoviricetes sp.
MSEKNMARRAAFQVRFAGTDITKSVEPYLLQMTYVDNEEDETDDLQLKLQDRDGIWLEKWLNSAIQAAAEGGKTLDSIPVDEDNAEYTTAYTYKVTAASGVNVHGRPGEQYYVYGTLAYGTVITSKGVEEGWVNFDFERKNAYVKLEHLTCIGSQQVKAQKSTSKKKTSSITAKSAANTASSNTAAAAGTWNIGDEVVANGQPQYSSYGNGTPGAAVTNYTGKITYLNLKSGIPYPICVGYLGWFAESQVKRTSESTTSTSSDERAASKGLKISAIILRENWNSDGKDDMLDCGQFELDSIDASGPPATITIKATSLPYASTVRQTQKSKSWENTTLSAIAKKIANSNGMACMFESSSDPSYKRTEQYRISDIGFLKKLCHDAGCSLKVTNNIIVIFDQAKYEKKKSVLTIKHGATGGYIKYKLTTGDNDTYTSCRVSYTTSNCAVISATAYVEDYKESKSDDTDKSKNQCLEVRQKVSSKDEAQALAHKMLRLHNKFEFTAAFTFPGNPSLVAGNAVTLQGWGAFDGKYIIKQAKHSITSSGYTTQITLRKSLDENADSAVKSNSTASTSGNLYDIAMAVIRGDWSNGAERKQKLTEAGYDYAAVQKRVNEILGG

SEQ ID NO: 2166 - protein, 432 aa, unidentified
  REGION 1..432: note = Caudoviricetes sp.
MNNILVILGASGVFFVAMALRGVFGYLKNKHISLDDLHFSWRKFFGGAITPIALTASIGALAALILAFLKLVGVSGLKVAGLDQISLANLEIGLFIADIGAIGYAMKEGLMAFGLSDKQIEQIRSTVESRKDNETTGIKIGLENNELVAVADNITPKQIIKDKQADDKSRPTDDEIEEAGQGASVNPLSRRLADGKWFGQCSRYSWYLATGIAMNYAPHPDYGPCNGNAMVDYLVSKLGWKRCGKQNGAIFSYNTSTYGHTGMVVDASRNIVNDCNWSPLTVSTHPLNLDAVGAVYACPADMLEAPKPPAPTPQPQPQPKPVDDNVVNAVLRGDYGNGNDRKARLEAAGYNYLDVQRAVNDRASAPAPASARIGDHVRTSDSVDQNGVSLNLAIINDGRSVWTENNDRGMAVLRLSDGTVRCAVKPESLTKV

SEQ ID NO: 2167 - protein, 172 aa, unidentified
  REGION 1..172: note = Streptococcus pyogenes GA40468
YRNGPDSYDCSSSVCSALIYAGASNPGWLLNTEYMHDWLIQNGYQLIAENADWASLRGDVFIWGMRGQSAGAGGHTGIFIDPDNIIHCNYARNNITIDNYNQTAAASGWMYSYVYRYSGSQTQPTNKSIDELAQEVLAGKHGSGEQRKISLGFNYDAVQAKVNEMLKQPKVA

SEQ ID NO: 2168 - protein, 352 aa, unidentified
  REGION 1..352: note = Streptococcus equi subsp. zooepidemicus R01422
LNTEYMHDWLVQNGYELIAENEDWESQRADIAIWGLRGQSAGAGGHVVMFIDADNIIHCNYARNNITIDNYNQTAAASGWMYSYVYRYAGTQSQPATSKSIDELAQEVLAGLHGSGEQRKISLGANYDAVQTKVNELLKQPKVAEQSPAVKQDGDLLFNGAVLKKSVLDTILTKCKEHDILPSYAITVLHFEGLWGQSTVGRTDNNWGGMTWTGQSNRPSGVTVTQGTARPAVEGGHYMHYASVDDFLTDWFYLLRVDSSYKVSGAKTFSEAIKGMFRVGGAKYDYAAAGYDNYMIGMSSRLKAIEAENGPLDKYDQQTVTDVGQPDNIDVVIDSIEITINGVTYTATKKPI

SEQ ID NO: 2169 - protein, 454 aa, Streptococcus pyogenes
MSENIPLRVQFKRMTASEWARSDVILLESEIGFETDTGFARAGDGHNRFSDLGYISPLDYNLLTNKPDIDGLATKVETAQKLQQKADKETVYTKAESKQELDKKLNLKGGVMTGQLQFKPNKSGIKPSSSVGGAINIDMSKSEGAGGHVVMFIDADNIIHCNYANNNITIDNYNQTAAASGWMYSYAYRYVGGTDKCVGSKSIDELAQEVLSGKHGSGEQRKISLGANYDAVQAKVNEMLKQPQVAEQSPAVKQDGDLLFNGAVLKKTVLDKILAKCKEHDILPSYAITVLHFEGLWGQSAVGRSDNNWGGMTWTGQGNRPSGITVTKGTARPLNEGGHYMHYSSVDDFLTDWFYLLRANGSYKVSGAKNFSEAVKGMFKVGGAVYDYAASGYDNYIVGMSSRLKAIEQENGPLNKYDKQTDISVGQSDKIDVVIDSIEITINGVTYTATKKPI

SEQ ID NO: 2170 - protein, 298 aa, Streptococcus pyogenes
NIIHCNYANNNITIDNYNQTAAASGWMYSYAYRYVGGTDKCVGSKSIDELAQEVLSGKHGSGEQRKISLGANYDAVQAKVNEMLKQPQVAEQSPAVKQDGDLLFNGAVLKKTVLDKILAKCKEHDILPSYAITVLHFEGLWGQSAVGRSDNNWGGMTWTGQGNRPSGITVTKGTARPLNEGGHYMHYSSVDDFLTDWFYLLRANGSYKVSGAKNFSEAVKGMFKVGGAVYDYAASGYDNYIVGMSSRLKAIEQENGPLNKYDKQTDISVGQSDKIDVVIDSIEITINGVTYTATKKPI

SEQ ID NO: 2171 - protein, 228 aa, unidentified
  REGION 1..228: note = Streptococcus pyogenes MGAS15009 MGAS15009
MTVDTEKAIAWMGLKEGRVSYSMDYRNGPDSYDCSSSVCSALIYAGASNPGWLLNTEYMHDWLIQNGYQLIAENADWASLRGDVFIWGMRGQSAGAGGHTGIFIDPDNIIHCNYARNNITIDNYNQTAVASGWMYSYAYRYVGGTDKCVGSKSIDELAQEVLSGKHGSGEQRKISLGANYDAVQAKVNEMLKQPKVAEQSPAVKQDGDLMFNGAVLKKSILDKILVKC

SEQ ID NO: 2172 - protein, 404 aa, Streptococcus pyogenes
MTVDTEKAIAWMGLKEGRVSYSMDYRNGPDSYDCSSAICSALIYAGASNPGWLLNTEYMHDWLVQNGYQLIAENEDWDSQRADIAIWGLRGQSAGAGGHVVMFIDADNIIHCNYANNNITIDNYNQTAAASGWMYSYVYRYTGPQTQQTSKSIDELAQEVLAGKHGSGEQRKISLGSNYDAVQAKVNDMLKQPQVAEQSPAVKQDGDLLFNGAVLKKTVLDKILAKCKEHDILPSYAITVLHFEGLWGQSAVGRADNNWGGMTWTGQGNRPSGITVTQGTVRPVAEGGHYMHYSSVDDFLTDWFYMLRAGGSYKVSSAKTFSESVKGMFKAGGAKYDYAASGYDNYIVGMSSRLKAIEAENGSLAKFDVGTVDNVGSTDKIEVNIEGIEISINGVTYTISKKPV

SEQ ID NO: 2173 - protein, 207 aa, unidentified
  REGION 1..207: note = Erysipelotrichaceae bacterium
MALKDKIEELKKGLNNTKAEAGKTTAKVAEEVSEKASEAKNAFDAAFEKAKKNLTEGKAAVEEKASEAKTAFDAAFEKAKRNLEKKEEEVKVEYKEVNLVDIARNVIRGDYGNGDDRVKRLTAAGFDYDRVQGIVNDLLAGRTPGGELVVKVPVKKEEIKSALKDTVTVAKEVIRGDWGNGDERVRRLTEAGYDYNTVQAKVNELLR

SEQ ID NO: 2174 - protein, 296 aa, Lachnospira sp.
MTFPILSTKYDHVNIFINELAPVVCNEYLKRRDVGEKLITPATVLAQAAKESGWNLNAATLFGIKGEGRELDTTEYIDGEYVHVKDCFAAYHDIAASVQGYYDLMQWDNYDDATAANTVEGELYGLTNAVDGTDKDSEGNYVGYNYATAPDYYQTTLDIINDFGLRAFNDYVFSYNKQDDESKSTQIDENIVDAIYRGEWGNGDERRERLNAAGYNYADYQARVEEKFYSNADDTYEQNDNSGKEERTATVQPGGSFWQIANDYLGDGNRAAELAEYNNMTLESGLYAGMVLKLPD

SEQ ID NO: 2175 - protein, 407 aa, Streptococcus canis
MTVDTEKAIAWMGLKEGRVSYSMNYRNGPDSYDCSSSVCSALIYAGASNPGWLLNTEYMHDWLIQNDYQLIAENEDWDSLRGDIFIWGMRGQSAGAGGHTGIFIDPDNIIHCNYARNNITIDNYNQTAAASGWMYSYVYRYSGSQTQPTNKSIGELAQEVLAGKHGSGEQRKLSLGSNYDAVQAKVNELLKQPQVAEQSPAVKQDGDLLFNGAVLKKAILDKILAKCKEHDILPSYAITCLHFEGLWGQSTVGRADNNWGGMTMTSSDMSIVRPSGVTVTRGSARPASEGGYYMHYTTVDDFLTDWFYLLCQGGSYKVSGAKTFSEAVKGMFKAGGAKYDYASIGYENYLVGASSRLKAIETENGSLSKFDTATLEDVGSKDKIDITIAGIEVTINGVTYTISKKPV

SEQ ID NO: 2176 - protein, 248 aa, Coprobacillus cateniformis
MAKMKVQDFITKAIQVEKVPTLYGWGKFMNSYNGNYLLCDCSGLIKGILWGYPEKGKYASNQVPDINANTMIKQCSKVSTNFHKLPLGALVWMEGHIGIHIGNGVCVESSPIWEDGIQCTFIKGSGYSNTRKLKERKWTKQGLFDKYIDYSQNPVQSHKSIFEIAKEIIAGLWGNGQERKQKLEKAGYNYHDVQSEVNKLISNPKTTTELAKEVIAGKWGNGTERRNKLIKAGYDYDAIQAKVNEILK

SEQ ID NO: 2177 - protein, 404 aa, Streptococcus castoreus
MTVDTEKAIAWMGLKEGRVSYSMDYRNGPDSYDCSSSVCSALIYAGASNPGWLLNTEYMHDWLVQNGYQLIAENADWASLRGDVFIWGMRGQSAGAGGHTGIFIDPDNITHCNYARNNITIDNYNQTAAASGWMYSYVYRYSGSQTQPTNKSIDELAKEVLAGKHGSGEQRKISLGANYDAVQAKVNEMLKQPQVAEQSPAVKQDGDLLFNGAVLKKAILDKILAKCKEHDILLSYAITVLHFEGLWGQSAVGRADNNWGGMTWTGQGSRPSGITVTKGTARPVAEGGHYMHYESVDDFLTDWFYLLRAGGSYKVSGAKTFSEAVKGMFIVGGAKYDYAASGFDSYIVGVASRLKAIEQENGPLSKYDQQTDISVGQSDKIDVVIDSLAITINGVTYTATKKPF

SEQ ID NO: 2178 - protein, 404 aa, Streptococcus agalactiae
MTVDTEKAIAWMQNKKGCVSYSMDYRNGPNSYDCSSSVCSALIYAGASNPGWLLNTEYMHDWLVQNGYQLISENDGWDSQRGDIFIWGQRGASAGAGGHTGMFVDADNIIHCNYANNNITINNYNETAAASGWMYSYAYRYTGSQSQPTNKSIDELAKEVLAGQHGSGEQRKLSLGTNYDAVQAKVNELLKQQKVAEQSPVVKQDGDLLFNGAVLKKSVLDKIIAKCKEHDILPSYAITVLHFEGIWGQSAVGRSDNNWGGMTWTGQGNRPSGITVTQGTARPSKEGGNYMHYASVDDFLTDWFYLLRQGGSYKVSGAKTFSEAIKGMFKAGGAVYDYAATGYDNYLVGMSSRLKAIEAENGSLAKYDVGTVDNVGSTDKIEVNIEGIEISINGVTYTISKKPV

SEQ ID NO: 2179 - protein, 295 aa, Streptococcus pyogenes
MTVDTEKAIAWMGLKEGRVSYSMDYRNGPDSYDCSSAICSALIYAGASNPGWLLNTEYMHDWLVQNGFELIAENEDWDSQRADIAIWGFRGQSAGAGGHVVMFIDADNIIHCNYANNNITIDNYNQTAAASGWMYSYAYRYVGGTDKCVGSKSIDELAQEVLSGKHGSGEQRKISLGANYDAVQAKVNEMLKQPQVAEQSPAVKQDGDLLFNGAVLKKTVLDKILAKCKEHDILPSYAITVLHFEGLWGQSAVGRSDNNWGGMTWTGQGNRPSGITVTKGTARPLNEGGHYMHYS

SEQ ID NO: 2180 - protein, 318 aa, unidentified
  REGION 1..318: note = Candidatus Nanosyncoccus alces
MLKGIDISHWQANLDIASTGAQFVICKATQGTTFVDPSCDRHYQIAKRLGLKLGVYHYASGGDPIAEADFFVRNIKGYIGEAILILDWEKNQNGRYHEHASWCLKFLNHVKELTGVKPLVYMSASVIKAADWSSVVNGDYGLWVAGYPDNRDSWDIPQFIWDVSPWKFYAIWQYTSSGGRLDRDVFMGDAAAWDKYANPSGNPAPSPAPTPAPARKSNEDLATEVIRGDWGNGQERKDRLTAAGYDYGAVQNIVNQRLAGSSGASTAENCSAVYYTVQKGDTLWGIAQKYGTTYQEIARLSGIPDPNKIYPGQKVRVK

SEQ ID NO: 2181 - protein, 405 aa, Streptococcus dysgalactiae
MTVDTEKAIAWMGLKEGRVSYSMDYRNGPDSYDCSSAICSALIYAGASNPGWLLNTEYMHDWLVQNGYELIAENVGWDSQRADIAIWGMRGQSAGAGGHVVMFIDADNIIHCNYANNNITIDNYNQTAAASGWMYSYAYRYVGGTDKCVGSKSIDELAQEVLSGKHGSGEQRKISLGANYDAVQAKVNELLKQPKVAEQSPAVKQDGDLLFNGAVLKKSILDKILVKCKEHDILPSYAITVLHFEGFWGQSAVGRSDNNWGGMTWTGQGNRPSGITVTQGTERPAVEGGHYMHYASVDDFLTDWFYLLRADGSYRVSGAKTFSEAVKGMFKVGGATYDYAASGYDNYIVGMAGRLKAIEQENGPLNKYDQQTDIDVGQSDKIDMVIDSIEITINGVTYTATKKPI

SEQ ID NO: 2182 - protein, 268 aa, Streptococcus canis
MTVDTEKAIAWMGSKEGRVSYSMDYRNGPDSYDCSSSVCSALIYAGASNPGWLLNTEYMHDWLVQNGYQLIAENADWASLRGDVFIWGIRGQSAGAGGHTGIFIDPDNIIHCNYARNNITIDNYNQTAAASGWMYSYVYRYSGSQTQPTNKSIDELAQEVLSGKHGSGEQRKISLGANYDAVQAKVNEMLKQPQVAEQSPAVKQDGDLLFNGAVLKKAILDKILAKCKEHDILPSYAITVLHFEGLWGTSAVGKADNNWGGMTWTGKG

SEQ ID NO: 2183 - protein, 415 aa, Bifidobacterium catenulatum
MVKHKPPWKALTAVLLAVFMAVAPAASADMNGYDVSGWQPANISRSAPADFVVVKATEGTNFRNGSWIAQATGATDTGKALGLYHYANGGSAIAEADYFVNTIGSYAGRAVLVLDWESYGNASWGNGSWVRTFVNRVHDRTSVWPMVYVQASAVWQVPSDVRQHCALWKAQYASNAATGYQSSPWNAGSAGESMLQYTSNGRLYGYNGPLDLNRFFGDKQAWGKIACGERKGCVPGSYASTGTPTTNAQASAPAPAQTPNANIGDMAARTIRGEYGNGSDRKARLGGYYDAVMAEVNRRLTGSTTTASSPAASTVTYCVVVRSGDTMSRIAADSGRLPASAWSVPSGNVNAIWPGQRVCYRGTASVARTASYNTYGHVVKSGESLWTIYGTGWANAAARNGLRAPYTIYPGQILR

SEQ ID NO: 2184 - protein, 348 aa, unidentified
  REGION 1..348: note = uncultured Senegalimassilia sp.
MSMRGIDCASYQAGIDPRNVPCDFIIVKSTQGTTYINPDFQRLADATLAAGKALGIYHYAAGGNATAEANHMLDVAGGYIGKAIFCLDWEGVQNKLFESGQDSAWIDEFCSVIEGRVGSACLVYISKSVMHYADSHKLWVAQYANMNRTGYQDHPWNEGAYDCTIRQYSSMGRLDGWGGDLDLNKAYMSREEWDAWAAGNGAPAPAGKSNDQIADEVIEGQWGNGDDRRNRLASAGYDYDAIQSIVNAKLQPSRKSNEQIADEVINGAWGNGNDRRNRLAQAGYDPDAIQSIVNAKLGASARQTYTVKSGDTLSGIAAKYGTSWKHLADINGIANPNLIYPGQVLTIG

SEQ ID NO: 2185 - protein, 450 aa, Streptococcus canis
MTVDTEKAISWMGSKEGRVSYSMNYRNGPNSYDCSSSVCSALIYAGASNPGWLLNTEYMHDWLVQNGYQLIAENADWASLRGDVFIWGMRGQSAGAGGHTGIFIDPDNIIHCNYARNNITIDNYNQTAAASGWMYSYVYRLANQNSTPSTSDKTIDTLVKETLAGKYGNGDQRKAALGNQYEAVMAVINGKATTTQKSIDELAQEVLSGKHGSGEQRKISLGANYDAVQAKVNEMLKQPQVAEQSPAVKQDGDLLFNGAVLKKTVLDKILAKCKEHDILPSYAITVLHFEGLWGQSAVGRSDNNWGGMTWTGQGNRPSGITVTKGTARPLNEGGHYMHYESVDDFLTDWFYLLRAGGSYKVSGAKTFSEAVKGMFIVGGAKYDYAASGFDSYIVGMASRLKAIEQENGPLNKYDQQTDISVGQSDKIDVVIDSLEIIINGVTYTATKKPI

SEQ ID NO: 2186 - protein, 251 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKNRSRKPK

SEQ ID NO: 2187 - protein, 384 aa, unidentified
  REGION 1..384: note = Caudoviricetes sp.
MDGYDISNWQCGIDTATVPADFVIVGTTWGSGGVYGGCLSNGVNTDANRQLAGAINSGKETGVYHYARGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPTVDLDALATRTIRGDFGNDPARRQALGSNYAAVMDIVNRRLSGSGVTTPSGNTGSYCVVVSSGDTMGAIASRTGRMPASAWSVPSGNINRIWPGQQVCYGGSTASSIGAHVVTTSHVVTAGESLWKIYGSGWPAAAQRNGLRAPYTIYPGQVLH

SEQ ID NO: 2188 - protein, 317 aa, unidentified
  REGION 1..317: note = Caudoviricetes sp.
MVMRGIDISKWQSGIDLSAVNADFVIVKATEGIGYVDKSCDGFFQKALSLGKKLGFYHFARPTNDPVREADFFYNNCRGYFGKGIPILDWESGNTGDVAWAKRWLDRVYQLSGVKPVIYMSESVVNVNNWSAVAAADYGLWVAKYRDNNPDYNYNMANAGSRPHVKWWKFYCMWQWTSSGRLDGYGSNLDCNVFYGDAATWDAYVGKSTSVAKPQPKPAAKTTSQLAEEVIAGQWGNGLDRKKRLAAAGYNYDAVQKVVNQKMAAKKQTTHVYYVVKRGDTLSGIASKYGTTYQRLAQINGIANPNRIYVGQKIRVK

SEQ ID NO: 2189 - protein, 321 aa, unidentified
  REGION 1..321: note = Caudoviricetes sp.
MQSKCLKRRVAKAMIKGIDISKWQGDFDLAEAKSEGQEFVIIKGGGGNDGLYVDRCFEANYKKAKALDMPVGCYFFSLAKSEAEAVKEAEYFYEKCLKGKQFDLPVYIDVEGEMLKIEKSKLTAIIKAWCDTLEAKGYFVGIYASLSAFENRMNDEELAIYTHWVAHWSNECGYKNKSILGVWQFGGEANPIRSNKVAGVVCDQDYMLIDYSDIIKNKGFNGYKKAAPAPAKKSVDTLAKEVIDGKWGNGSERKKKLTSAGYNYKAVQARVNYLLETRLEKIALEVIRGEWGNGSERKKKLKAAGYDYNEVQKLVDAYYKK

SEQ ID NO: 2190 - protein, 288 aa, unidentified
  REGION 1..288: note = Bacteriophage sp.
MMRLTEMQKVIDVSYHNGSIDWERVKSAGYHAIIRCGYGSNFENQDDEQFKHNANECVRLGIPFGCYLYSYAKGSTQAMSEAEHAIRLCAPYRDAMAYPLFFDTEESGTEAVSASHAVIFCSRVKAAGFVPGIYASQAWWRENLSNVNGYVKWVARWSATQPDTSAWQLWQYSEKGNVPGINGNVDLNYSRYTLKVTSNTAYVDAVASEVIAGKWGNGEVRRKKLGRVANIVQLIVNHDLTGKWTGVDKVAREVIAGMWGNGETRKSNLGSAYDAVQKRVNDLLKQKS

SEQ ID NO: 2191 - protein, 412 aa, unidentified
  REGION 1..412: note = Caudoviricetes sp.
MNPRRQWRKLLTALTVAISMAVAPAAMADMNGYDISNWQCGIDTATVPADFVIVGTTWGSGGVYGGCLSNGVNTDANRQLAGAIDSGKETGVYHYARGGNPETEARFFIDNVRGYVHKSVLILDWEAQDNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTIDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWKIYGSGWPAAAQRNGLRAPYTIYPGQVLH

SEQ ID NO: 2192 - protein, 275 aa, unidentified
  REGION 1..275: note = Caudoviricetes sp.
MNIRTQKPVNNKFYQTKVKGGFSLCIKGSPTDPTCDVLANCVGYACGRFNEIIGEMKYPTLYCNAENFIERAKSLGLEISNKPTLGGIMVWQKGETLKSSDGAGHVAIVERIDNDNQIYTSESGYKSSAFWNSIRTNSNGRWGMSDRYKFIGCIVNPGVRVENEPTKVEKTIDELAHEVLKGVYGNGEDRKQKLGDKYEAVQNKVNELLKNNNDIKVGDRVVPTNLYDYKGFRVHQYDEFYEVSQIDNRGYLLRAIRGDQRPIWAIMPKNNIRKV

SEQ ID NO: 2193 - protein, 285 aa, unidentified
  REGION 1..285: note = Bacteriophage sp.
MSRMQKVIDVSYHNGTIDWDRVKAAGYHAIIRCGFGSDFRDQDDAQFKRNADECVRLGIPFGAYLYSYAKGAAQAMSEADHAIRLCDPYRDHMAYPLFFDTEEPGTEDVSKTHATIFCSRVRAAGFVPGIYASQAWWLENLPDVDGYVKWVARWSESEPIVHGWQLWQYSERGNVPGIKGNVDLNYSRYEIGNYGDVSTVDDLAREVIAGKYGNGEERKRKLGARASVVQLIVNHDLTGKWTGVDKVAREVIAGMWGNGETRKSNLGSAYDAVQKRVNDLLKQKS

SEQ ID NO: 2194 - protein, 473 aa, unidentified
  REGION 1..473: note = Bacteriophage sp.
MDRRSHPHARHPRRRLDNHLTSYFPTNRKAIPQGVAFSIAPNRGGKERNLSILNKGNPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2195 - protein, 248 aa, unidentified
  REGION 1..248: note = Caudoviricetes sp.
MAKMKVQDFITKAIQVEKVPTLYGWGKFMNSYNGNYLLCDCSGLIKGILWGYPEKGKYASNQVPDINANTMIKQCSKVSTNFHKLPLGALVWMEGHIGIHVGNGVCVESSPIWEDGIQCTFIKGSGYSNTRKLKERKWTKQGLLDKYIDYSQNPVQSHKSIFEIAKEIIAGLWGNGQERKQKLEKAGYNYHDVQSEVNKLISNPKTTTELAKEVIAGKWGNGTERRNKLIKAGYDYDAIQKKVNEILK

SEQ ID NO: 2196 - protein, 340 aa, unidentified
  REGION 1..340: note = Lachnospiraceae bacterium
MLNVIDVSYHNGKIDWKTVKGKIDGVIIRCGYGNNLAAQDDPQWKQNADECTRLQIPFGTYLYSYAQNDVQAKSEAEHVLRLVKGYRLSFPIYYDLEAPGIEDAAVRNAKIFGGIVEKAGYMAGIYANNDWFNRIIKDHLDQYTKWIARFSEKRPDQLCDMWQYTSTGSVPGIVGNVDRSRCYRDFPAELTGTVLPPQPESDANEIADEVIAGQWGNGDERKKRLEAAGYDYNAIQALVNEKLKKPVDAIAREVIAGQWGNGRERTSRIRAAGYDPAEVQQRVNALLGESGEAIQYYTIKYGDTLSEIAKKYGTTQQSLIQLNGIRHPDKIYAGQRIRIS

SEQ ID NO: 2197 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSTSNKSLDQLVKETLAGVHGNGDARKASLGNQYEPVMAVINGKATAPKKTVDQLAQEVIQGKHGNGEDRKKSLGPDYDAVQKRVTEILQGNTSGNTPKTPLDAPKSEVVNSSTEPKTEETGATGKATDTKITKEDGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRSGGSYKVSGAKTFSEAIKGMFKTGGAVYDYAASGFDNYIVGASSRLKAIESENGSLDKFDKLTDTDVGQSDDIEVNVEGIEVIINGETYKLEKKPV

SEQ ID NO: 2198 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWVAKRGDIFIWGRRGQSAGAGGHTGIFIDPDNIIHCNYARNGITVDNYNQTAAASGWMYCYVYRLANQTSTSDKSLETLVQETLAGRYGNGDARKAALGNQYEAVMAVINGKTTTSQKTVDQLAQEVIQGKHGNGEARKKSLGSQYEAVQKRVTELLKKQPSEPSKSSEAKQVTESKTSQTETTEKVIVSKEDGDLSFNGAILKKAVLDKILTNCKKHDILPSYALTILHYEGLWGTSAVGKADNNWGGMTWTGQGNRPSGVTVTQGSARPSNEGGHYMHYATVDDFLKDWFYLLRAGGSYKVSGAKTFSEAVKGMFKVGGAVYDYAASGFDSYIVGASSRLKAIESENGILSKYDTATVTDVGSKDHIDITIDGIEVIINGETYKLEKKPV

SEQ ID NO: 2199 - protein, 481 aa, Streptococcus suis
MTINLETSIRWMSDRVGKVTYSMDYRNGPNSYDCSSAVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETRATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIESENGSLAKYDQQTVTDVAKTDKIEVAIEGIEVTINGTRYKLTKEPI

SEQ ID NO: 2200 - protein, 472 aa, Streptococcus suis
MAANMEQAIAWMEARRGKVTYSMDYRNGPNSYDCSSSVYFALMSAGAITAGWAVNTEYMHDWLIKNGFKLIAENSVFAAQRGDIFIWGRRGQSSGAGGHTGIFVDSNNIIHCNYARNGITIDNYLATARASGNMYYYIYRPSGQSTVSTSTAGKSIDQLVQETLAGKYGNGDQRKAALGNQYEAVMAVINGKATAPKKTVDQLAQEVIQGKHGNGEDRKKSLGPDYDAVQKRVSELLQKQPSEPSNSSEVKQVTETKTSQTEPTGQATESKEDGDLSFNGAILKKAVLEKILANCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSDAIKGMFKVGGATYDYAASGFDSYIVGASSRLKAIESENWSFAKYDQQTVTNVGQSDEIEINVEGIEVIINGETYKLEKKPV

SEQ ID NO: 2201 - protein, 479 aa, Streptococcus suis
MALNMEQAIAWMEARRGKVTYSMDYRNGPGSFDCSSSVYYALMSAGAISAGWAVNTEFEHDWLIKNGYKLIAENQDWDAKLGDIFIWGRRGQSSGAGGHTGIFIDPDNIIHCNYARNGITVDNYNQTAAASGWMYCYVYRLANQTSTSDKSLETLVHETLAGKYGNGDQRKAALGNQYEAVMSVINGKATAPKKTVDQLAQEVIQGKHGNGEDRKKSLGPDYDAVQKRVTEILKGSTSGSAPKTPSDTPKSEVVNSTTEPKKAETGTTGKATEPKIAKEVGDLSFNGAILKKSVLDVILAKCKEHDILPSYALTILHFEGLWGTSAVGKADNNWGGMTWTGQGQRPSGVAVTQGSARPSNEGGHYMHYASVDDFLTDWFYLLRAGGSYKVSGAKTFSDAIKGMFKTGGAVYDYAATGYDNYLVGMSSRLKAIEAENGSLAKYDTATVTDVGSTDKIEVNIEGIEIAINGVTYELTKKPV

SEQ ID NO: 2202 - protein, 468 aa, Streptococcus suis
MGINTETAIAWMSARQGKVSYSMDYRDGPNSYDCSSSVYYALRSAGASSAGWAVNTEYEHDWLIKNGYILIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDQRKAALGNQYEAVMAVINGKATAPKKTVDQLAQEVIAGKHGNGEARKKSLGSQYEAVQKRVTELLKKQPSEPSKAQEVKQPTETKISQTEPTGQATATKEEGDLSFNGAILKKAVLDKILANCKKHDILPSCALTILHYEGLWGTSAVGKADNNWGGMTWTGQGNRPSGVTVTQGSARPSNEGGHYMHYATVDDFLTDWFYLLRKDGSYKVAGAKTFSEAVKGMFKVGGAVYDYAASGFDSYIVGASSRLKAIESENGTLSKYDTATVTDVGSKDNIDITIDGIEVIINGETYKLEKKPV

SEQ ID NO: 2203 - protein, 476 aa, Streptococcus suis
MTINLETSIRWMSDRVGKVSYSMDYRNGPNSYDCSSAVYYALMAGGAISAGWVVNTEYMHDWLIRNGYVLVAENKPFNAQRHDVCILGKRGYSSGAGGHVVIFVDNVNVIHCNYARNGITIDNYNQVHRGMYYYLYRPANQPSTSNKSLDQLVKETLAGVHGNGDARKASLGNQYEPVMAVINGKATAPKKTVDQLAQEVIQGKHGNGEDRKKSLGPDYDAVQKRVTEILQGNTSGNTPKTPLDAPKSEVVNSSTEPKTEETGATGKATDTKITKEDGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRSGGSYKVSGAKTFSEAIKGMFKTGGAVYDYAASGFDNYIVGASSRLKAIESENGSLDKFDKLTDTDVGQSDDIEVNVEGIEVIINGETYKLEKKPV

SEQ ID NO: 2204 - protein, 479 aa, Streptococcus suis
MTINLETSIRWMSDRVGKVSYSMDYRNGPNSYDCSSAVYYALMAGGAISAGWAVNTEYEHDWLIKNGYTLIAENTDWDAKRGDIFIWGRRGQSAGAGGHTGIFVDPDNIIHCNYARNGITVDNYNQTAAASGWMYCYVYRLANQTSTAGKSLETLVQETLAGKYGNGDTRKTALCNQYEAVMAVINGKASASQKSVDELAQEVIQGKHGNGEDRKKSLGPDYDAVQKRVTEILKGSTSGNAPKTPSDAPKSEVVNSSTEPKTEETGATGKATDTKITKEDGDLSFNGAILKKSVLDVILSNCKKHDILPSYALTILHYEGLWGTSAVGKADNNWGGMTWTGKGERPSGVTVTQGTARPANEGGHYMHYASVDDFLTDWFYLLRSGGSYKVSGAKTFSDAVKGMFKIGGAVYDYAASGFDSYIIGASSRLKAIEAENGSLDKFDKQTVTDVGQSDKIEVTIEGIEISINGVTYTLSKKPV

SEQ ID NO: 2205 - protein, 481 aa, Streptococcus suis
MTINIETAIRWMTDRVGLVKYSMDYRNGPNSFDCSSSVYYALMAGGAISAGWAVNTEYEHDWLIKNGYKLIAENQDWDAKRGDIFIWGRRGQSSGADGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKSMFKTGGAVYDYAATGYDNYLVGMSSRLKAIESENGSLAKYDQQTVTDVAKTDKIEVAIEGIEVTINGTRYKLTKEPI

SEQ ID NO: 2206 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNTQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAAKKTVDQLAQEVIQGKHGNGEDRKKSLGPDYDAVQKRVTEILKGSTSGNAPKTPSDAPKSEVVNSSTEPKTEETGATGKATDTKITKEDGDLSFNGAILKKSVLDVILANCKKHDILPSYALTILHYEGLWGTSAVGKADNNWGGMTWTGKGERPSGVTVTQGTARPANEGGHYMHYASVDDFLTDWFYLLRSGGSYKVSGAKTFSEAVKGMFKVGGAVYDYAASGFDSYIVGASSRLKAIEFENGSLDKFDKQTVTDVGQSDDIEINVEGIEVIINGETYRLEKKPV

SEQ ID NO: 2207 - protein, 484 aa, Streptococcus suis
MTVNIETAIAWMSARAGKVTYSMDYRNGPGSYDCSSSVYYALMSAGAISAGWAVNTEYEHDWLIKNGYKLIAENQDWDAKRGDVFIWGKRGQSSGAGGHTGIFIDPDNIIHCNYARNGITVNNYNQTAAASGWMYCYVYRLANQPSNSTTGKSLDTLVKETLAGVYGNGDTRKAALGNQYEAVMAVINGKATAPKKTVDQLAQEVIQGKHGNGEDRKKSLGPDYDAVQKRVTEILKGSTSGNTPKTPSDAPKSDVVNSSTEPKTEETGATGKATDTKITKEDGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2208 - protein, 476 aa, Streptococcus suis
MTINLETSIRWMSDRVGKVSYSMDYRNGPNSYDCSSAVYYALMAGGAISAGWVVNTEYMHDWLIRNGYVLVAENKPFNAQRHDIFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIQGKHGNGEDRKKSLGPDYDAVQKRVTEILKGSPSGNIPKTPSDAPKSEVVNSSTEPKTEETGANGKATDTKITKEDGDLSFNGAILKKSVLDVILAKCKEHNILPSYAITVLHFEGLWGTSAIGKTDNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLSKYDTATVTDVGSTDKIEVNIEGIEISINGVTYELTKKPV

SEQ ID NO: 2209 - protein, 481 aa, Streptococcus suis
MAANMEQAIAWMEARRGKVTYSMDYRNGPNSYDCSSSVYFALMSAGAISAGWAVNTEYMHDWLIKNGFKLIAENSVFAAQRGDIFIWGRRGQSAGAGGHTGIFVDPDNIIHCNYARNGITIDNYNQTAAASGWMYCYVYRLAKQPTTSPSGKTLDTLVKETLAGKYGNGDQRKAALGNQYEAIMAVINGKATAPKKTVDQLAQEVIQGKHGNGEDRKKSLGPDYDAVQKRVTEILKGSTSGNTPKTPSDAPKSEVVNSSTEPKTEETGATGKATDTKITKEDGDLSFNGAILKKSVLDVILDKCKEHNILPSYAITVLHFEGLWGTSAVGKVDNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLDKFDTATVTDVGSTDKIEVNIEGIEISINGVTYELTKKPV

SEQ ID NO: 2210 - protein, 481 aa, Streptococcus suis
MTINLETSIRWMSDRVGKVSYSMDYRNGPNSYDCSSAVYYALMSAGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLANQPTTSPSGKNLDTLVKETLAGKYGNGDQRKAALGNQYEAVMAVINGKVTAPKKTVDQLAQEVIQGKHGNGEDRKKSLGPDYDAVQKRVTEILKGSTSGNTPKTPSDAPKSDVVNSSTEPKTEETGATGKATDTKITKEDGDLSFNGSVLKKAVLDKILANCKKHDILPSYALTILHYEGLWGTSAVGKADNNWGGMTWAGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVIINGETYKLEKKPV

SEQ ID NO: 2211 - protein, 468 aa, Streptococcus suis
MGVNIETALRWMSDRKGRVTYSMDYRNGPNSFDCSSSVYYALMSAGAISAGWAVNTEYEHDWLVRNGYTLIAENTDWDAKRGDIFIWGRRGQSAGAGGHTGIFIDPDNIIHCNYARNSITVDNYNQTAAASGWMYCYVYRLANQTSTSGKSLETLVQETLAGKYGNGDTRKAALGNQYEAVMAVINGKATAPKKTVDQLAQEVIQGKHGNGEDRKKSLGPDYDAVQKRVTELLKKQPSEPSKSSEVKQVTETKTSQTEPTGNAAANKEDGDLSFNGAILKKAVLDKILTNCKKHDILPSYALTILHYEGLWGTSAVGKADNNWGGMTWTGQGNRPSGVTVTQGSARPSNEGGHYMHYASVDDFLTDWFYLLRKDGSYKVSGAKTFSDAVKGMFKTGGAVYDYAASGFESYIIGASSRLKAIEAENGSLDKFDKQTVTDVGQSDKIEVTIEGIEISINGVTYTLSKKPV

SEQ ID NO: 2212 - protein, 481 aa, Streptococcus suis
MAANMEQAIAWMEARRGKVIYSMDYRNGPNSYDCSSSVYFALMSAGAVSAGWAVNTEYMHDWLIKNGYKLITENQDWDAKRGDIFIWGRRGQSSGAGGHTGIFVDPDNIIHCNYANNSITINNYNQTAAASGWMYCYVYRLANQPTTSPSGKTLDTLVKETLAGKYGNGDQRKAALGNQYEAVMAVINGKVTAPKKTVDQLAQEVIQGKHGNGEDRKKSLGPDYDAVQKRVTEILKGSTSGNTPKTPSDAPKSEAVNSSTEPKTEETGATGKATDTKITKEDGGLSFNGAILKKSVLDVILAKCKEHNILPSYAITVLHFEGLWGTSAVGEADNNWGGMTWTGKGERPSGVTVTQGTARPANEGGHYMHYASVDDFLTDWFYLLRSGGSYKVSGAKTFREAIKGMFKTGGAVYDYAATGYENYLVGMSSRLKAIEVENGSLAKYDTATVTDVGSTDKIVVNIEGIEISINGVTYTLSKKPV

SEQ ID NO: 2213 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTAGKSLETLVQETLAGKYGNGDTRKAALGNQYEAVMAVINGKATTNQKTVDQLAQEVIAGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIEAENGSLSKYDTAIVTDINQSDDIEINVEGIEVIINGETYKLEKKPV

SEQ ID NO: 2214 - protein, 481 aa, Streptococcus suis
MTINIETAIRWMTDRVGLVKYSMDYRNGPNSFDCSSSVYYALMAGGAISAGWAVNTEYEHDWLIKNGYKLIAENQDWDAKRGDIFIWGRRGQSSGADGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2215 - protein, 481 aa, Streptococcus suis
MAVNIEAAIAWMSARVGKVTYSMDYRNGPGSYDCSSSVYYALMSAGAISAGWAVNTEYEHDWLVKNGYKLIAENQDWDAKRGDIFIWGRRGQSSGAGGHTGIFVDPDNIIHCNYANNSITINNYNQTAAASGWMYCYVYRLANQPTTSPSGKNLDTLVKETLAGKYGNGDQRKAALGNQYEAVMAVINGKVTAPKKTVDQLAQEVIQGKHGNGEDRKKSLGPDYDAVQKRVTEILKGSTSGNTPKTPSDAPKSDVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2216 - protein, 468 aa, Streptococcus suis
MTINLETSIRWMSDRVGKVSYSMDYRNGPNSYDCSSAVYYALMAGGAISAGWAVDTEHMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 2217 - protein, 481 aa, Streptococcus suis
MAVNIEAAIAWMSARVGKVTYSMDYRNGTGSYDCSSSVYYALMSAGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLANQPTTSPSGKTLDTLVKETLAGKYGNGDQRKAALGNQYEAVMAVINGKATAPKKTVDQLAQEVIQGKHGNGEDRKKSLGPDYDAVQKRVTEILKGSTSGNTPKTPSNAPKSDVANSSTEPKTEETGATGKATDTKITKEDGDLSFNGAILKKSVLDVILAKCKEHNILPSYAITVLHFEGLWGTSAVGKADNNWGGMTWTGKGERPSGVSVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2218 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTAGKSLETLVQETLAGKYGNGDTRKAALGNQYEAVMAVINGKATTNQKTVDQLAQEVIAGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFNSYIVGASSRLKAIEAENGSLSKYDTAIVTDINQSDDIEINVEGIEVIINGETYKLEKKPV

SEQ ID NO: 2219 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTAGKSLETLVQETLAGKYGNGDQRKAALGNQYEAVMAVINGKATTSQKTVDQLAQEVIAGKHGNGEARKKSLGSQYEAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2220 - protein, 354 aa, Streptococcus suis
ARNGITVDNYNQTAAASGWMYCYVYRLANQTSTAGKSLETLVQETLAGKYGNGDQRKAALGNQYEAVMAVINGKATTSQKTVDQLAQEVIAGKHGNGEARKKSLGSQYEAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2221 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWVAKRGDIFIWGRRGQSAGAGGHTGIFIDPDNIIHCNYARNGITVDNYNQTAAASGWMYCYVYRLANQTSTSDKSLETLVQETLAGRYGNGDTRKAALGNQYEAVMAVINGKTTTSQKTVDQLAQEVIQGKHGNGEARKKSLGSQYEAVQKRVTELLKKQPSEPSKSSEAKQVTESKTSQTETTEKVIVSKEDGDLSFNGAILKKAVLDKILTNCKKHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKAGGAVYDYAASGFDSYIVGASSRLKAIESENGTLSKYDTATVTDVGSKDHIDITIDGIEVIINGETYKLEKKPV

SEQ ID NO: 2222 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDSYNQTAAASGWMYCYVYRLANQTSTAGKSLETLVQETLAGKYGNGDTRKAALGNQYEAVMAVINGQSSASQKSVDELAQEVIQGKHGNGEARKKSLGSQYEAVQKRVTELLKKQPSEPSKSSEVKQVTEAKTSQTETSEKVTASKEDGDLSFNGAILKKAVLDKILVNCKKHDILPSYALTILHYEGLWGTSAVGKADYNWGGMTWTGKGERPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 2223 - protein, 468 aa, Streptococcus suis
MGVNIETALRWMSDRKGRVTYSMDYRNGPNSFDCSSSVYYALMSAGAISAGWAVNTEYEHDWLIKNGYTLVAENTDWDAKRGDIFIWGRRGQSAGAGGHTGIFVDPDNIIHCNYARNGITVDNYNQTAAASGWMYCYVYRLANQTSTAGKSLETLVQETLSGKYGNGDTRKAALGDQYEAVMAVINGKATASQKSIDELAQEVIAGKHGNGEARKQSLGADYPAVQKRVTELLKKQASEPSKSSEVKQVTETKTSQTEPTGNATVNKEEGDLSFNGAILKKAVLDKILANCKKHDILPSYALTILHYEGLWGTSAVGKGDNNWGGMTWTGQGNRPSGVTVTQGSARPSNEGGHYMHYATVDDFLTDWFYLLRSGGSYKVSGAKTFSEAIKGMFKTGGAVYDYAASGFDSYIVGASSRLKAIEAENGTLSKYDTATVTDVGSKDHIDITIDGIEVIINGETYKLEKKPV

SEQ ID NO: 2224 - protein, 470 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGKRGQSAGAGGHTGIFIDSDNIIHCNYARNGITVDNYNQTAAASGWMYCYVYRLTNQSTPSTSGKTLDALVKETLAGKYGNGDTRKAALGDQYEAVMAVINGKATASQKSIDELAQEVIAGKHGNGEARKQSLGADYPAVQKRVTELLKKQASEPSKSSEVKQVTETKTSQTEPTGNATVNKEEGDLSFNGAILKKAVLDKILANCKKHDILPSYALTILHYEGLWGTSAVGKGDNNWGGMTWTGQGNRPSGVTVTQGSARPSNEGGHYMHYATVDDFLTDWFYLLRSGGSYKVSGAKTFSEAIKGMFKTGGAVYDYAASGFDSYIVGASSRLKAIESENGTLSKYDTATVTDVGSKDHIDITIDGIEVIINGETYKLEKKPV

SEQ ID NO: 2225 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATSYENYLVGMSSRLTAIESENGSLAKYDQQTVTDVAKIDKIEVAIEGIEVTINGTRYRLTKEPI

SEQ ID NO: 2226 - protein, 479 aa, Streptococcus suis
MGVNIETALRWMSDRKGRVTYSMDYRNGPNSFDCSSAVYYALMSAGAISAGWAVNTEYEHDWLIKNGYTLIAENSDWDAKRGDIFIWGRRGQSAGAGGHTGIFVDPDNIIHCNYARNGITVDNYNQTAAASGWMYCYVYRLANQTSTSGKSLETLVQETLAGKYGNGDQRKAALGNQYEAVMAVINGKTTTSQKTVDQLAQEVIQGKHGNGEDRKKSLGPDYDAVQKRVTEILKGSTSGNTPKTPSDAPKSEVVNSSTEPKSEETGATGKATDTKITKEDGDLSFNGAILKKSVLDVILAKCKEHNILPSYAITVLHFEGLWGTSAVGKADNNWGGMTWTGKGERPSGVTVTQGIARPANEGGHYMHYASVDDFLTDWFYLLRAGGSYKVSGAKTFSEAVKGMFKTGGAVYDYAATGYDNYLVGMSSRLKAIEAENGSLAKYDTATVTDVGSTDKIEVNIEGIEISINGVTYELTKKPV

SEQ ID NO: 2227 - protein, 468 aa, Streptococcus suis
MALNMEQAIAWMSARVGKVTYSMDYRNGPGSYDCSSSVYYALMSAGAISAGWAVNTEYEHDWLVKNGYKLIAENQDWDAKRGDIFIWGKRGQSAGAGGHTGIFIDADNIIHCNYANNSITINNYNQTAAASGWMYCYVYRLTNQTSTSGKSLETLVQETLAGKYGNGDTRKAALGNQYEAVMAVINGKATTPKKSIDQLAQEVIAGKHGNGEARKQSLGNQYEAVQKRVTELLKKQPSEPSKSSEVKQPTETKTSQTEPTGQATVSKEDGDLSFNGAILKKAVLDKILANCKKHEILPSYALTILHYEGLWGTSAVGKADNNWGGMTWTGQGNRPSGVTVTQGTARPANEGGHYMHYASVDDFLTDWFYLLRSGGSYKVSGAKTFSEAVKGMFKTGGAVYDYAATGYDNYLVGMSSRLKAIEQENGSLAKYDISTVTDVGSTDKIEVNIEGIEISINGVTYTLSKKPV

SEQ ID NO: 2228 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGKRGQSAGAGGHTGIFIDSDNIIHCNYARNGITVDNYNQTAAASGWMYCYVYRLANQTSTSGKSLETLVQETLAGKYGNGDQRKAALGNQYEAVMAVINGKATVPKKTIDQLAQEVIAGKHGNGEARKQSLGADYPAVQKRVSELLKKQPSESSKSPEVKQVTETKTSQTEPTGQTTANKEDGDLSFNGAILKKAVLDKILANCKKHDILPSYALTILHYEGLWGTSAVGKADNNWGGMTWTGQGNRPSGVTVTQGSDRPSNEGGHYMHYASVDDFLTDWFYLLRAGGSYKVSGAKTFSEAVKGMFKVGGAVYDYAASGFDSYIVGASSRLKAIESENGTLSKYDTVTVTDVGSKDHIDITIDGIEVIINGETYKLEKKPV

SEQ ID NO: 2229 - protein, 465 aa, Streptococcus suis
MTINLETSIRWMSDRIGKVTYSMDYRNGPDSYDCSSAVYFALMAGGAISVGWAVNTEYMHDWLIRNGYVLVAENKPFNAQRHDVCILGKRGYSSGAGGHVVIFVDNVNVIHCNYARNGITIDNYNKVHHGMYYYLYRPANQPSTSNKSLDQLVKETLAGKYGNGDTRKAALGNQYEAVMAVINGKATASQKSIDELAQEVIAGKHGNGEARKQSLGADYPAVQKRVSELLKKQPSEPSKSPEVKQATETKTSQTESTGQATANKEEGDLSFNGAILKKAVLDKILANCKKHDILPSYALTILHYEGLWGTSAVGKADNNWGGMTWTGKGERPSGVTVTQGSARPSNEGGHYMHYGSIDDFLTDWFYLLRSGGSYKVSGAKTFSEAVKGMFKVGGAVYDYAASGFDSYIVGASSRLKAIESENGTLSKYDTATVTDVGSKDHIDITVDGIEVIINGETYKLEKKPV

SEQ ID NO: 2230 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSDAVKGMFKVGGAAYDYAASGFDSYIVGASSRLKAIESENGSLAKYDQQTVTDVAKTDKIEVAIEGIEVTINGTRYKLTKEPI

SEQ ID NO: 2231 - protein, 308 aa, Streptococcus suis
HGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2232 - protein, 468 aa, Streptococcus suis
MTINLETSIRWMSDRVGKVSYSMDYRNGPNSYDCSSAVYYALMAGGAISAGWAVDTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2233 - protein, 469 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2234 - protein, 468 aa, Streptococcus suis
MAANMEQAIAWMEARRGKVTYSMDYRNGPNSYDCSSSVYFALMSAGAISAGWAVNTEYMHDWLIKIGFKLIAENTDWDAKRGDIFIWGRRGQSAGAGGHTGIFVDPDNIIHCNYARNGITVDNYNQTASASGWMYCYVYRLANQTSTSGKSLETLVQETLAGKYGNGDQRKAALGNQYEAVMAVINGKATAPKKTVDQLAQEVIAGKHGNGEDRKKSLGPDYDAVQKRVSELLKKQPSEPSNSQEVKQPTETKTSQTDPTGNATVNKEEGDLSFNGAILKKAVLDVILAKCKEHNILPSYAITVLHFEGLWGTSAVGKADNNWGGMTWTGKGERPSGVTVTQGTARPANEGGHYMHYASVDDFLTDWFYLLRLGGSYKVSGAQTFSEAIKGMFKTGGAVYDYAATGYDNYLVGMSSRLIAIEAENGSLAKFDTATVTDVGSIDKIEVNIEGIEISINGVTYELTKKPV

SEQ ID NO: 2235 - protein, 444 aa, Streptococcus suis
YRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDNYNQTAAASGWMYCYVYRLANQTSTAGKSLETLVQETLAGKYGNGDTRKAALGNQYEAVMAVINGQSSASQKSVDELAQEVIQGKHGNGEARKKSLGSQYEAVQKRVTELLKKQPSEPSKSSEVKQVTEAKTSQTETSEKVTASKEDGDLSFNGAILKKAVLDKILVNCKKHDILPSYALTILHYEGLWGTSAVGKADYNWGGMTWTGKGERPSGVTVTQGSARPSNEGGHYMHYASVDDFLTDWFYLLRAGGSYKVSGAKTFSEAVKGMFKIGGAVYDYAASGFDSYIVGASSRLKAIESENGTLSKYDTATVTDVGSKDHIDITIDGIEVIINGETYKLEKKPV

SEQ ID NO: 2236 - protein, 283 aa, Streptococcus suis
NGKATTSQKTVDQLAQEVIAGKHGNGEARKKSLGSQYEAVQKRVSELLKKQPSEPSKSSEVKQVTETKTSQTEPTGQATESKEDGDLSFNGAILKKAVLEKILANCKKHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGALSRLKAIESENGSLDKFDKQTVSDVVQSDNIEINVEGIEVIINGETYRLEKKPV

SEQ ID NO: 2237 - protein, 468 aa, Streptococcus suis
MTINLETSIRWMSDRVGKVIYSMDYRNGPNSYDCSSAVYYALMAGGAISAGWAVNTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2238 - protein, 274 aa, Streptococcus suis
MTINLETSIRWMSDRVGKVIYSMDYRNGPNSYDCSSAVYYALMAGGAISAGWAVNTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGA

SEQ ID NO: 2239 - protein, 468 aa, Streptococcus suis
MTINLETSIRWMSDRVGKVSYSMDYRNGPNSYDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDTRKAALGNQYEAVMAVINGKATTNQKTVDQLAQEVIAGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGQRPSGVTVTQGSARPSNEGGHYMHYASVDDFLTDWCYLLRAGGSYKVSGAKTFSEAVKGMFKVGGAVYDYAASGFDSYIVGASSRLKAIEAENGSLSKYDTAIVTDINQSDDIEINVEGIEVIINGETYKLEKKPV

SEQ ID NO: 2240 - protein, 389 aa, Streptococcus suis
QRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2241 - protein, 481 aa, Streptococcus suis
MTINIETAIRWMTDRVGLVKYSMDYRNGPNSFDCSSSVYYALMAGGAISAGWAVNTEYEHDWLIRNGYKLICENGRFDAQRGDVFIWGRRGQSSGAGGHTGIFIDPDNIIHCNYARNGITVDNYNQTAAASGWMYCYVYRLANQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNTPKTPSDTPKSEVVNSSTEPKTEETGATGKATDTKITKEDSDLSFNGAILKKSVLDVILAKCKEHNILPSYAITVLHFEGLWGTSAVGKADNNWGGMTWTGKGKRPSGVTVTQGTARPANEGGHYMHYASVDDFLTDWFYLLRSGGSYKVSGAKTFSEAIKGMFKTGGAVYDYAATGYDNYLVGMSSRLKAIESENGSLAKYDQQTVTDVAKTDKIEVAIEGIEVTINGTRYKLTKEPI

SEQ ID NO: 2242 - protein, 242 aa, Streptococcus suis
MTINIETAIRWMTDRVGLVKYSMDYRNGPNSFDCSSSVYYALMAGGAISAGWAVNTEYEHDWLIRNGYKLICENGRFDAQRGDVFIWGRRGQSSGAGGHTGIFIDPDNIIHCNYARNGITVDNYNQTAAASGWMYCYVYRLANQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGN

SEQ ID NO: 2243 - protein, 456 aa, Streptococcus suis
MGVNIETALRWMSDRKGRVTYSMDFRNGPNSFDCSSSVYYALMSAGAISAGWAVNTEYEHDWLVKNGYTLIAENTDWDAKRGDIFVWGRRGQSAGAGGHTGIFVDPDNIIHCNYARNGITVDNYNQTAAASGWMYCYVYRLANQTSTAGKSLETLVQETLAGKYGNGDTRKAALGNQYEAVMAVINGKASASQKSVDELAQEVIQGKHGNGEARKKSLGSQYEAVQKRVTELLKKQPTETKTSQTVPTGNATVNKEEGDLSFNGAILKKAVLDKILANCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2244 - protein, 481 aa, Streptococcus suis
MTINIETAIRWMTDRVGLVKYSMDYRNGPNSFDCSSSVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIESENGSLAKYDQQTVTDVAKTDKIEVAIEGIEVTINGTRYKLTKEPI

SEQ ID NO: 2245 - protein, 396 aa, Streptococcus suis
ENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2246 - protein, 457 aa, Streptococcus suis
MSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2247 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYARNGITVDNYNQTAAASGWMYCYVYRLSNQTSTSGKSLETLVQETLAGKYGNGDTRKAALGNQYEAVMAVINGKATASQKSIDELAQEVIAGKHGNGEARKQSLGADYPAVQKRVSELLKKQPSEPSKTQEVKQVTETKTSQTEPTGQATASKEEGDLSFNGAILKKAVLDKILANCKKHDILPSYALTILHYEGLWGTSAVGKADNNWGGMTWTGQGNRPSGVTVTQGSARPSNEGGHYMHYASADDFLTDWFYLLRAGGSYKVSGAKTFSEAVKGMFKVGGAVYDYAASGFDSYIVGASSRLKAIESENGTLSKYDTTTVTDVGSKDHIDITIDGIEVIINGETYKLEKKPV

SEQ ID NO: 2248 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAWVHGNGDARKASLGNQYEPVMAVINGKATASQKTIDELVQEVIAGKHGNGEERKKSLGPDYDVVQKRVTEILKGGTLGNTPKTPSDAPKSEVVNSSTEPKTEETRATGKVTEPKIVKEAGDLSFNGAILKKSILDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 2249 - protein, 468 aa, Streptococcus suis
MTINLETSIRWMSERVGKVSYSMDYRNGPNSYDCSSAVYYALMSGGAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 2250 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPINQPSTSNKSLDQLVKETLAGVHGNGDARKASLGNQYEPVMAVINGKATAAKKSIDELVQEVIAGKHDNGEERKKSLGPDYDAVQKRVTEILKSDTSGNTPKTPSDTPKSGAVNSTTEPKKAETETTGKATEPKKNKEVGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQSDKIEVAIEGIEVTINGTRYKLTKEPI

SEQ ID NO: 2251 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPTNQPSTSNKSLDQLVKETLAGVHGNGDTRKASLGSQYEAVMAVINGKATAPKKTVDQLAQEVIQGKHGNGEDRKKSLGPDYDAVQKRVTEILKGSTSGNAPKTPSDAPKSEVVNSSTEPKTEETGATGKATDTKITKEDGDLSFNGAILKKSVLDVILAKCKEHNVLPSYAITVLHFEGLWGTSAVGKADNNWGGMTWTGKGERPSGVTVTQGTARPANEGGHYMHYASVDDFLTDWFYLLRLGGSYKVSGAKTFSEAIKGMFKTGGAVYDYAASGFDSYIIGASSRLKAIEAENGSLDKFDKQTVTDVGQSDKIEVTIEGIEISINGVTYTLSKKPV

SEQ ID NO: 2252 - protein, 385 aa, Streptococcus suis
VCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKVTAPKKTIDELVQEVIAGKHGNGEERKKSLGPDYDVVQKRVSELLKKQPSEPSKGVEVKQPTETKISQTEPPEQATVSKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAIKGMFKTGGAVYDYAATGYDNYLVGMSSRLKAIEAENGTLSKYDTATVTDVAKTDKIEVAIEGIEVTINGTRYRLTKDPI

SEQ ID NO: 2253 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGETRKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2254 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMAVINGKTTTNQKTVDQLAQEVIAGKHGNGEARKKSLGSQYDAGQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 2255 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHDMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2256 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGNSLDTLVKETLAGNYGNGEARKAVLGNQYEAVMSVINGKTTTNQKTVDQLVQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2257 - protein, 292 aa, Streptococcus suis
SNKSLDQLVKETLAGVHGNGDARKASLGNQYEPVMAVINGKATTSQKTVDQLAQEVIAGKHGNGEARKKSLGSQYEAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYSSVDDFLTDWFYLLRANGSYKVSGAKTFSEAVKGMFKVGGAVYDYAATGYDNYLIGMSSRLKAIEFENGSLDKFDKQTVMDV

SEQ ID NO: 2258 - protein, 465 aa, Streptococcus suis
MVINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSTSNKSLDQLVKETLAGVHGNGDARKASLGNQYEPVMAVINGKATTSQKTVDQLAQEVIAGKHGNGEARKKSLGSQYEAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKVGGATYDYAASGFDSYIVGASSRLKAIESENGSLDKFDKQTVTDVGQSDDIEINVEGIEVIINGETYKLEKKPV

SEQ ID NO: 2259 - protein, 424 aa, unidentified
  REGION 1..424: note = Bifidobacteriaceae bacterium
MNILNKGKPKHMKPRRQWRTLLTALAIAVSMAFAPAAMADMDGYDISNWQCGIDTATVPADFVIVGTTWGSGGVYGGCLSNGVNTDANRQLAGAINSGKETGVYHYARGGDPETEARFFVDNVRGYVHKSVLILDWEAQDNAAWGDKQWPRRWAREVKRLTGVNPIIYTMDSGYWQVAGMETELNCGIWIAQYATNLVTGYQTAPWNLGARGEVMRQYTSNGSLSGWSGRLDLNRFRGDRAAWRKYANPDDKGTASLPNVKPTPQPTTAPTVDLDALATRTIRGDFGNDPARRQALGSNYAAVMAIVNRRLSGSGVTTPSGNTGYCVVVSSGDTMGAIASRTGRTPASAWSVPSGNINRIWPGQRVCYGGTTASNVSAHVVGTSHVVTAGESLWTIYGATGWQAAAQRNGLSYPYIIHPGQVLR

SEQ ID NO: 2260 - protein, 464 aa, Bifidobacterium merycicum
MTAFDGLVKTAVADFPKNRKAISSEMAFSIAPNRGGKERNLDILNKGKPAHRHARIPRRIRTPLAALAVAVSMAFAPAAMADMDGYDISNWQCGINTASVPADFVIVGTTWGSGDVYGGCLSNGVNTDANRQLAGAINSGKETGVYHYARGGNPETEARFFVDNVRGYVHKSVLILDWEAQDNAAWGDKQWPRHWAREVKRLTGVNPIIYTMDSGYWQVAGMETELNCGIWIAQYATNLVTGYQTAPWNLGARGEVMRQYTSNGSLSGWSGRLDLNRFRGDRAAWRKYANPDDKGAASLPNVRPTPQPTTAPKVDLDALATRTIRGDFGNDPARRQALGSNYAAVMAIVNRRLGGGTASTGANCGGVCVTVRAGDTLGSIAARNGGTWSQWTGYRSGNPDLIYAGETVCRRAAGSSTAIASATGGHVVRSGESLWSIYGTGWQAAAQRNGLHAPYTIYPGQHLR

SEQ ID NO: 2261 - protein, 399 aa, unidentified
  REGION 1..399: note = Aerococcaceae bacterium zg-1292
MLEKVLFIANQYVGAPKYGTAHKELVDTYNAARPLPQGYRVTYDDDWCDVFVSSVFIKAGVSKLIGRECGVQRHIQLFKQLGIWLGETKPQRGDIITFDWDRGGFADHIGIVEDVSGDTVKTIEGNSNGKVSRNHFKWNDARIVGYARPKYKQQTMNKPSIDILVKEVLAGKHGVGEERKHSLGINYDAVQKKVNEILSKPDEIALTYRSETLRKYHLDLILKLCKQYQIIPSFAITVLHFEGMWGHSFVGRSDNNWGGMTWTGSVKRPSGVVVSKGSARPQSEGGHYIRYQSVEDFLIDWFYLLRQGGSYRVSGQKTFRESVQGLFQIGGATYNYAATPYETYLIRVVSRKTSIESETGISLERWDPKELKNYKESTTVIEDDYEIVVNGVKYVLVKQ

SEQ ID NO: 2262 - protein, 90 aa, unidentified
  REGION 1..90: note = Clostridiales bacterium
MDMVVRNARERIGLEESNSTQNELKCSIIKKWDLTKYDVKKASPSKKSAETLAKEVIQGKWGNGDERKKKLTAAGYDYDAVQKRVNEVMK

SEQ ID NO: 2263 - protein, 227 aa, Coprobacillus cateniformis
LYGWGKFMNSKQGQYLLCDCSGLIKGILWGYPEKGKYASNQVPDINANTMIKQCSKVSTNFNKLPLGALVWMEGHIGIHVGNGICVESSPIWEDGIQCTFIKGSGYSNTRKLKERKWTKQGLFDKYIDYSQNPAQSHKSIFEVAKEIIAGLWGNGQERKQKLEKAGYNYHDVQSEVNKLISNPKTTTELAKEVIAGLWGNGTERRNKLIKAGYDYDAIQKKVNEILK

SEQ ID NO: 2264 - protein, 334 aa, unidentified
  REGION 1..334: note = Clostridia bacterium
MSRSSLASIYVPASTNNYTQGRRGYKVCKITPHHMAGKLTARQCGNIFANPSRQASSNYGIGYDGEIACYVDEENRAWTSSNRANDCQAITIEVANSANGEPWPISDAAWNSLVKLCVDICRRYGFRLTYDGTPNGSLTRHDMFANTNCPGKTLGGRFKELADTVNAQLDGKVEPTPSTPSGSKSNEELADEVIAGKWGNGDDRKNRLNAAGYNYSAIQSIVNQKLSGGSSAPKASTKSNETIAQEVINGAWGNGQERKDRLTAAGYDYNAIQSIVNQKLGAGSSSNSNKKSNETIANEVIRGDWGNGQDRKNRLQAAGYDYNAIQAIVNRKLS

SEQ ID NO: 2265 - protein, 1306 aa, unidentified
  REGION 1..1306: note = Burkholderiaceae bacterium
MSKQIDERVVSMRFDNKHFESNVQTSMSTLDKLKAKLNLSGASKGLENVNSAAKKVDMSGLAGGIETVSAKFSSLQVVGVTALANITNSAINAGKRFVESLTIAPIKDGFSEYELTLNAVQTTMSGTGKTAEEVEKQLKSLDEYADKTVYSTADMLNNLPKFTNAGVDLEKATTAMIGIANATALAGGDAGKASIAFYNLGQAIGTGYLTRMDYNSINNAGIATMEWKNQMVDAAIAAGTLTKAGDDLYAAGDKTFTLQQLFIDGLQEQWATTDVMMKVFGDYGDETTEIGKKAYSAAQDVKTFSQMMESLKATAGTGWKDTWQTIFGGLDEAKQFWTDLSNSLSGIITGIANWRNKLLNGALGKGFSKLSKTLSTITDPIKKTVKTVKGATTAIKNLGEMANRVIRGEFGNGKARFEALTKAGYNYYAIQNKVNEKLGYAFRYSDKLAGSQKELTTTEEELTSADAKRLEQLSKMSDEELENLGLTKKQIKALRELKKYVDMTGLSFSEFVENIDEIDGRWLLINSFKNVGQGLVAVFKALKDAWVEIFPPMTSDQLFNIIGGLHKFSTHLRVSEETAENLKRTLKGVFAALDIVLTIVGGPIKIAFKILMQLLKAFDLDILDVTAVIGDAIVKFRDWIDSTIDFTGIFKTIAPYIKEAIDAVKGWIDSVKPLEKIEAAFKKVTDAVKDFAKSIRESDIVQNIISGLTNGLKNGASKVWKAIVDLAKGMLEKIKSVLGIHSPSTEFEEVGENAVLGLANGLKGGISTIANIIKTLCSKMFSAFGEFDWSNISTIFTNIARLFPKLKIFTTISALGNIFAVGGKDVVMGFVNGLAKSASAIWEAITSIAKNVISKFKDILGIHSPSAVFFAIGGFIIAGLVGGLMSGSANIKDALTALGSWVINFFKGLDLGTVVAAGATIGALILIKKILDITDKFASAAKSVGGLADSLKNLADNFNTKLFGQFNKSKWELISEALLKMAIAIGILAASVIIMSMIEPGKLWGAVGALGVLIVALGALAGIIVGLMAATKLVGDGKSIAVIGNMLLKIAIAMGIMAVVAKIAGSMYSDDLKQGALAIVAFGGIIVALMWATKLLGNSAQISTIGGTLVKISYAIGIMLLVAKSAASMTVAELKQGIQAIAAFSGIIIALMAATRLVNGGEFTDKVGKSIFKIAGAIAIMLIVAKIAASMSIGDIVKGTLTIAAFSGIIIGLMKAAKTISGAKNVDKIGGAILKMAFAMTLMAIAAKIAASMSIGEIVQGTLAIAAFGGMVVGLMAATKLVGDGKSIAVIGNMLLKIAIAMGIMA

SEQ ID NO: 2266 - protein, 334 aa, unidentified
  REGION 1..334: note = Clostridia bacterium
MSRSSLASIYVPASTNNYTQGRRGYKVCKITPHHMAGKLTARQCGNIFANPSRQASSNYGIGYDGEIACYVDEENRAWTSSNRANDCQAITIEVANSANGEPWPISDAAWNSLVKLCVDICRRYGFRLTYDGTPNGSLTRHDMFANTNCPGKTLGGRFKELADTVNAQLDGKVEPTPSTPSGSKSNEELADEVIAGKWGNGDDRKNRLTAAGYNYSAIQSIVNQKLSGGSSAPKASTKSNETIAQEVINGAWGNGQERKDRLTAAGYDYSAIQSIVNQKLGAGSSSNSNKKSNETIANEVIRGDWGNGQDRKNRLQAAGYDYNAIQAIVNRKLS

SEQ ID NO: 2267 - protein, 203 aa, unidentified
  REGION 1..203: note = Bacteroidaceae bacterium
MVQLKRKVTLKRKLDLLEKEGEELSTPISEPPVGSAPAPEPAPAPEPQGSQGRGKIAIVLGLLAVLGLGYGAYQWMGASGDEATAAVAQTESAPDNTASAAAPEAAPAPEVAAAPEAAPAPEAAAAPEAAAAAAPAPVQSKSAPAAAPAAAPSTATLTPDALTSKANEVIRGQYGNGLKRRQMLGEQYQTIQDKVNELYRLKR

SEQ ID NO: 2268 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGDQYEPVMAVINGKATAPKKTVDQLAQEVIAGKHGNGEERKKSLGPDYDVVQKRVSELLKKQPSEPSKGVEVKQPTETKISQTEPPGKATVSKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAASGFDSYIVGASSRLKAIESENGSLAQYDQQTVIDVAKTDKIEVAIEGIEVTINGTRYRLTKDPI

SEQ ID NO: 2269 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPTNQPSTSNKSLDQLVKETLAGIHGNGDARKASLGNQYEPVMAVINGKATASQKTIDELVQEVIAGKHGNGEERKKSLGPDYDVVQKRVTEILKSGTSGNTPKTPSDTPKSGAVNSSTEPKTEETGATGKATDTKITKEDGDLSFNGAILKKSILDVILAKCKEHNILPSYAITVLHFEGLWGTSAVGKADNNWGGMTMTSNDLQITRPSGVIVTRGLARPSNEGGYYMHYASVDDFLTDWFYLLRTGGSYKVSGAKTFSEAVKGMFKVGGAVYDYAATGYENYLVGMSSRLKAIESENGSLAKYAQQTVTDVAKTDKIEVAIEGIEVTINGTRYRLTKDPI

SEQ ID NO: 2270 - protein, 481 aa, Streptococcus suis
MTINLETSIRWMSDRIGKVSYSMDYRNGPNSYDCSSAVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETGATGKATDTKITKEDGDLSFNGAILKKSVLDVILAKCKEHNILPSYAITVLHFEGLWGTSAVGKADNNWGGMTWTGQGNRPSGVVVTQGLARPSNEGGHYMHYASVDDFLTDWFYLLRAGGSYKVSGAKTFSEAVKGMFKIGGAVYDYAASGFDSYIVGASSRLKAIESENGSLDKFDKLTNTDVGQSDDIEVNVEGIEVTINGTRYKLTKEPI

SEQ ID NO: 2271 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATASQKTIDELVQEVIAGKHGNGEERKKSLGPDYDVVQKRVTEILKGGTLGNTPKTPSDAPKSEVVNSSTEPKTEETRATGKVTEPKIVKEAGDLSFNGAILKKSILDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 2272 - protein, 423 aa, unidentified
  REGION 1..423: note = Bifidobacteriales bacterium
MPKTRRICMRWSHARHARAKPGYGRIMVGALAVLAMLTPGAAYADAGFDNASYQGCYNAQAARDSGASFSITKITEGTWYVNPAADCQIAANRAAGLRLGAYAYARPEKGTSPEAEADFFNAQANARGLVHAGVIPFLDWEPPVSHRGDTQWAKRWLDRVASYWGTKPIIYMSASTISAGDWRAVAGADYGLWVAGYPHGYKGERLRDPGAPPYSVAPWPFAAAWQYSSTGHVPGVGTAVDVNWWYGDAHTWAKYANAPVGTQANPVAPAPTPSQGAPVGDVGSLATAVIRGEYGNDPQRQALLGNRYDEVMAVVNERLRGNTGGGTGSGIYVVRPGDSLSAVFGGSWPMVARLNGISPPYVIHPGQRLATGNGGGGGGRTVTVQRGDTLSGIAARLGIPQSRLHGYRSGNPNKIQIGEVLHY

SEQ ID NO: 2273 - protein, 403 aa, unidentified
  REGION 1..403: note = Aerococcaceae bacterium NML191219
MTASKILEIFRGWLGATKYGSTHKHIIDTYNSVTPLPVGYRVTYDDDWCDATVTTAFIKAGLLDLIGQECSVQRHINICKSKGIWLGKQRPQAGDLVMWDWDANGWGDHIGIVESVAGETITTIEGNTTKNGVSCVGRNTYKWNDWRIQGYARPKYGASAALAKSVDELAQEVINGLHGTGDARKRALGAQYNAVQKRVNELLGAEPIGLKLGNHTLTQSVLDKILALCKHYDILPSFAITVLHYEGLWGNSSVGKSDKNWGGMTWTGDPQRKSGVVVTKGSARPASEGGHYMRYASVDDFLKDWFYLLRKGGIYQVAGQKSFEACVKGMFKVGGATYDYAGAGYEKYLIGMATRKKDIEQVNGSLSKYDATTIKEATQDDIKVDRDNLEVYINGERYVRETK

SEQ ID NO: 2274 - protein, 426 aa, Bifidobacterium adolescentis
MNILNKGKPKHKHMNPRRQWRKLLTALAVAISMAVAPAAMADMNGYDISNWQCGIDTATVPADFVIVGTTWGSGGVYGGCLSNGVNTDANRQLAGAINSGKETGIYHYARGGNPETEARFFVDNVRGYIRKSVLILDWEAQDNTAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2275 - protein, 469 aa, Streptococcus suis
MGVNIETAIHWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDADNIIHCNYARNGITVDNYNQTAAASGWMYCYVYRLANQTSTSGKSLETLVQETLVGKYGNGDTRKAALGNQYEAVMAVINGKATASQKSIDELAQEVIQGKHGNGEARKQSLGADYPAVQKRVSELLKKQRSEPSKTQEVKQPTTTKTSQTEPTGKATVSKEEGDLSFNGAILKKAVLDKILDNCKKHDILPSYALTILHYEGLWGTSAVGKTDNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIELENGSLTRFDATSNNVHSVDPDKISVDIDGIEVTINGVVYKLEKKPV

SEQ ID NO: 2276 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDADNIIHCNYARNGITVDNYNQTAAANGWMYCYVYRLANQTSTLGKSLETLVQETLAGKYGNGDQRKAALGNQYEAVMAVINGKATASQKSIDELAQEVIQGKHGNGETRKKLLGRQYEAVQKRVSELLKKQPSEPLKSPEVKQTTEAKTSQTEPTGQATESKEEGDLSFNGAILKKAVLDKILANCKKHDILPSYALTILHYEGLWGTSAVGKADNNWGGMTWTGQGQRPSGVTVTQGSARPSNEGGHYMHYASVDDFLTDWFYLLRASGSYKVSGAKTFSEAVKGMFKVGGAVYDYAASGFDSYIVGASSRLKAIEAENGTMSKYDTATVTDVNQSDDIEINVEGIEVIINGETYKLEKKPV

SEQ ID NO: 2277 - protein, 457 aa, Streptococcus suis
MEARRGKVTYSMDYRNGPNSYDCSSSVYFALMSAGAISAGWAVNTEYMHDWLIKIGFKLIAENTDWDAKRGDIFIWGRRGQSAGAGGHTGIFVDPDNIIHCNYARNGITVDNYNQTAAASGWMYCYVYRLANQTSTSGKSLETLVQETLAGKYGNGDQRKAALGNQYEAVMAVINGKATAPKKTVDQLAQEVIAGKHGNGEDRKKSLGPDYDAVQKRVSELLKKQPSEPSNSQEVKQPTETKTSQTDPTGNATVNKEEGDLSFNGAILKKAVLDVILAKCKEHNILPSYAITVLHFEGLWGTSAVGKADNNWGGMTWTGKGERPSGVTVTQGTARPANEGGHYMHYASVDDFLTDWFYLLRLGGSYKVSGAQTFSEAIKGMFKTGGAVYDYAATGYDNYLVGMSSRLIAIEAENGSLAKFDTATVTDVGSTDKIEVNIEGIEISINGVTYELTKKPV

SEQ ID NO: 2278 - protein, 167 aa, unidentified
  REGION 1..167: note = Coriobacteriia bacterium
PAPLQELKSDYSYQVSYRDYADDDDDDDGFYDYYGNARASESEVQVLALQVIEGKFGNGEMRKAVLGDLYAVVQNKINELLGSPVRYVQPKNVMGPTMYSNGFYAASMQSQVDAQTIDALAKRVIKGEFGSGKMRKALLGDLYELVQARVNEMIHGMVIQALDRSQI

SEQ ID NO: 2279 - protein, 426 aa, Bifidobacterium pseudocatenulatum
MNILNKGKPKHKRMNPRRQWRKLLTALAVAISVAVAPAAMADMNGYDISNWQCGIDTATVPADFVIVGTTWGSGGVYGGCLSNGVNTDANRQLAGAIDSGKETGVYHYARGGNPETEARFFVDNVRGYVHKSVLILDWEAQDNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPSGNTGYCVVVSSGDTMSAIASRAGRTPASAWSVPSGNINRIWPGQQVCYGGSTASSVGAHVVTTSHVVTAGESLWTIYGPSGWQAAAQRNGLSYPYVIHPGQVLR

SEQ ID NO: 2280 - protein, 268 aa, Anaerococcus hydrogenalis
MTNSKLIDEIILSPNHSGLRNEKISKIAIHHAAGVIKGRDLAKIFLPRQRQASSNYIIGSDGKIILGVDEKNRAWTTSSPWCDNRAITIEVGNSTRGPNWEISDFVLDRLIELVTDICIRNNIYPCTYTGDKNGVLQKHEWYANTNCPGPFLGNKFSYIAREVNKRLRKNKKQNLNLYRVRKSFNDKKSQKGAFKSFDNAKKCAKKYNLRVFDESGNEIYPRNNLKSVDTLAREVIRGDWGNGEERKYRLEKAGYNYDLIQKKVNSLM

SEQ ID NO: 2281 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDTRKAALGNQYEAVMAVINGKATTNQKTVDQLAQEVIAGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGQRPSGVTVTQGSARPSNEGGHYMHYASVDDFLTDWCYLLRAGGSYKVSGAKTFSEAVKGMFKVGGAVYDYAASGFDSYIVGASSRLKAIEAENGSLSKYDTAIVTDINQSDDIEINVEGIEVIINGETYKLEKKPV

SEQ ID NO: 2282 - protein, 481 aa, Streptococcus suis
MAVNIEAAIAWMSARVGKVTYSMDYRNGPGSYDCSSSVYYALMSAGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLANQPTTSPSGKTLDTLVKETLAGKYGNGDQRKAALGNQYEAVMAVINGKATAPKKTVDQLAQEVIQGKHGNGEDRKKSLGPDYDAVQKRVTEILKGSTSGNTPKTPSDAPKNEVVNSTTEPKKAETGTTGKATDTKITKEDGDLSFNGAILKKSVLDVILAKCKEHNILPSYAITVLHFEGLWGTSAVGKADNNWGGMTWTGQGNRPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2283 - protein, 426 aa, Bifidobacterium longum
MNILNKGKPRHKHMNPRRQWRKLLTALTVAISMAVAPAAMADMNGYDISNWQCGIDTATVPADFVIVGTTWGSGGVYGGCMSNGVNTDANRQLAGAVNSGKETGVYHYARGGNPETEARFFVDNVRGYIRKSVLILDWEAQDNAAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGAASLPNVRPTTQPTTAPTVDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2284 - protein, 333 aa, Bifidobacterium adolescentis
MNILNKGKPKHKRMNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYVHKSVLILDWEAQDNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPYGNTGYCVVVSS

SEQ ID NO: 2285 - protein, 322 aa, unidentified
  REGION 1..322: note = Bacilli bacterium
MKKLIAMTSLAASLLSAGVVNADMFGTDVSSWNPIGHEVTANTQFTIIKATQGVYYKNPSFDTQLANAKANGFLVGLYHYADGTGTPEQEADYFLSVVGDNIGNVVLALDWESGQNYAWGDKDWAKRFIDHVYNKTKVYPMIYVSASSIGEVANVSDKSALWLAGYPTNSPGFDVPNFIYSTGPWSTPTIWQYTSGGGLDMNYAYIDANGWNAIAKGERSSDNSNWTTPAASVDTNSLEGLASAVMSGYYGNGAEREQQLGDLYEAVQIIVNERLGLIDADTAHYLLADQIITYGNLGTGQDRESLLGSYANSVQDIINSVL

SEQ ID NO: 2286 - protein, 482 aa, Streptococcus suis
MAVNIEAAIAWMSARVGKVTYSMDYRNGPGSYDCSSSVYYALMSAGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLANQPTTSPSGKNLDTLVKETLAGKYGNGDQRKAALGNQYEAVMAVINGKATAPKKTVDQLAQEVIQGKHGNGEDRKKSLGPDYDAVQKRVTEILKGSTSGNTPKTPSDAPKSEVVNTSTEPKTEETGATGKATDTKITKEDGDLSFNGAILKKSVLDVILAKCKEHNILPSYAITVLHFEGLWGTSAVGKADNNWGGMTWTGQGNRPSGVVVTQGLARPSNEGGHYMHYASVDDFLTDWFYLLRKGGPYNVSGALTFSESVKGMFQVGGAKYDYAAAGYNSYLVGATSRLKAIESENGSLTRFDATSNNVHSVDPDKISVDIEGIEVTINGVVYKLEKKPV

SEQ ID NO: 2287 - protein, 481 aa, Streptococcus suis
MTINIETAIRWMTDRVGKVSYSMDYRNGPNSYDCSSAVYYALMAGGAISAGWAVNTEYEHDWLIKNGYKLIAENQDWDAKRGDIFIWGRRGQSSGADGHTGIFVDPDNIIHCNYANNSITINNYNQTAAASGWMYCYVYRLANQPTTSPSGKTLDILVKETLAGKYGNGDQRKAALGNQYEAVMAVINGKVTAPKKTVDQLAQEVIQGKHGNGEDRKKSLGPDYDAVQKRVTEILKGSTSGNTPRTPSDAPKSEAVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2288 - protein, 418 aa, Streptococcus suis
MHDWLIRNGYVLVAENKPFNAQRHDVCILGKRGYSSGAGGHVVIFVDNVNVIHCNYARNGITIDNYNQVHRGMYYYLYRPANQPSTSNKSLDQLVKETLAGVHGNGDARKASLGNQYEPVMAVINGKATAPKKTVDQLAQEVIQGKHGNGEDRKKSLGPDYDAVQKRVTEILQGNTSGNTPKTPLDAPKSEVVNSSTEPKTEETGATGKATDTKITKEDGDLSFNGAILKKSVLDVILAKCKGHNILPSYAITILHFEGLWGTSAVGKADNNWGGMTWTGQGNRPSGVTVTQGSARPSNEGGHYMHYASVDDFLTDWFYLLRSGGSYKVSGAKTFSEAIKGMFKTGGAVYDYAASGFDNYIVGASSRLKAIESENGSLDKFDKLTDTDVGQSDDIEVNVEGIEVIINGETYKLEKKPV

SEQ ID NO: 2289 - protein, 414 aa, unidentified
  REGION 1..414: note = Bifidobacterium phage BigBern1
MRWSHARHARAKPKYGRIMVGALAVLAMLSPGIANADAGFDNASYQGCYNAQAARDSGASFSITKITEGTGYVNPAADCQLAANRAAGLRLGAYAYARPEYGNSPEVEADHFNAQANARGLVHAGVIPFLDWEPPAPYNSHTDWAKRWLDRVASYWGTKPIIYMQASNIQAGDWRAVAGADYGLWVAGYPRGYVGERLRDPGAPPYSVAPWPFAAAWQYSSTGHVPGVGTAVDVNWFYGDAGTWARYANAPIGTQANPVTPSPTPSQGAPVGDVGSLATAVIRGEYGNDPQRHALLGNRYDEVMAVVNERLRGNTGGGTGSGIYVVRPGDCLSAVFGGSWPVIAQLNGIRAPYIIYPGQRLATGHGGGGGRTVTVQRGDTLSGIAARLGIPQSQIHGYRSGNPSLIYAGEVLHY

SEQ ID NO: 2290 - protein, 473 aa, Bifidobacterium pseudocatenulatum
MDRRSHPHARHPRRRLDNHLTSYFPTNRKAIPQGVAFSIAPNRGGKERNLNILNKGKPKHMKPRRRWRTPLTALAVAVSMAFAPAAMADMDGYDISNWQCGIDTATVPADFVIVGTTWGSGGVYGGCLSNGVNTDANRQLAGAINSGKETGVYHYARGGNPETEARFFVDNVRGYVHKSVLILDWEAADNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRTAWRKYANPGDKGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2291 - protein, 473 aa, Bifidobacterium pseudocatenulatum
MDRRSHPHARHPRRRLDNHLTSYFPTNRKAIPQGVAFSIAPNRGGKERNLSILNKGKPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2292 - protein, 473 aa, Bifidobacterium pseudocatenulatum
MDRRSHPHARHPRRRLDNHLTSYFPTNRKAIPQGVAFSIAPNRGGKERNLSILNKGKPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSERLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRMPASAWSVPSGNINRIWPGQQVCYGGSTASSIGAHVVTTSHVVTAGESLWKIYGSGWPAAAQRNGLRAPYTIYPGQVLH

SEQ ID NO: 2293 - protein, 341 aa, unidentified
  REGION 1..341: note = Stenotrophomonas phage vB_SmeS_BUCT702
MSNPTILLIAGHGSGDPGATGYISKGEHRYMKEDFFPAMKKFIPEGSNIVFFSDYNVYMRGNLVALAKSYGPNTIVVEMHYDALQMDSGASGGHVIVHDDFVPDSIDLAIRDAIKKNVGVRYTHKGHSGISGRSNLANVNRAANGGVNYRLVELGFCTDKGDVDVMLNKTEQYVKDFVEALIGKTNTAKPSATTNKVSSGKSSISGKSVDTLANEVIQGNYGSGDDRKRALGNMYNSVQKRVNEILAGKGATVKLSVNQMAKNVIAGKYSTGEARKKALGSDYNAVQAEVNRILGVSVKSVDTVAREVIDGKWGNGADRRNRLTAAGYNYNAVQARVNQIL

SEQ ID NO: 2294 - protein, 468 aa, Streptococcus agalactiae
MEINTEIAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPFKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2295 - protein, 468 aa, unidentified
  REGION 1..468: note = Streptococcus
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2296 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKTTDIGDGSKDKIDITIEGIEVTINGITYELTKKPV

SEQ ID NO: 2297 - protein, 479 aa, Streptococcus agalactiae
MGINTETAIAWMSARQGKVSYSMDYRDGPNSYDCSSSVYYALKSAGASSAGWAVNTEYMHDWLIKNGYQLIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAALGNQYEAVMAVINGKTTTNQKTVDQLAQEVIAGKHGNGEDRKKSLGPDYDAVQKRVSEILKGSTSGNTPKTPSDAPKSEVVNSSAEPKTEETGANGKATDTKNTKEDGDLSFNGVILKKSILDIILAKCKEHDILPSYAITVLHFEGLWGTSAVGKADNNWGGMTWTGQGNRPSGVTVTQGSARPSNEGGHYMHYASVDDFLTDWFYLLRAGGSYKVAGAKTFSEAVKGMFKVGGAVYDYAASGFDSYIVGASSRLKAIEAENGSLDKFDKATDIGDGSKDKIDITIEGIEVTINGITYELTKKPV

SEQ ID NO: 2298 - protein, 468 aa, Streptococcus agalactiae
MGINTETAIAWMSARQGKVSYSMDYRDGPNSYDCSSSVYYALRSAGASSAGWAVNTEYMHDWLIKNGYQLIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAALGNQYEAVMAVINGKTTTNQKTVDQLAQEVIAGKHSNGEARKKSLGSQYDAVQKRVTELLKKQPSEPSKAQKVNKPTETRTSQTEPAEKATVSKEDGDLSFNGTILKKAVLDKILANCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAIYDYAASGFDSYIVGASSRLKAIEAENGSLDKFDKATDIGDGSKDKIDITIEGIEVTINGITYELTKKPV

SEQ ID NO: 2299 - protein, 481 aa, Streptococcus suis
MTINIETAIRWMTDRVGLVKYSMDYRNGPNSFDCSSSVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETWATGKATDTKITKEDGDLSFNGAILKKSVLDVILANCKKHDILPSYALTILHYEGLWGTSAVGKADNNWGGMTWTGKGERPSGVTVTQGTARPACEGGHYMHYASVDDFLTDWFYLLRSGGSYKVSGAKTFSDAVKGMFKIGGAVYDYAASGFDSYIIGASSRLKAIEAENGSLDKFDKQTVTDVGQSDKIEVTIEGIEISINGVTYTLSKKPV

SEQ ID NO: 2300 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNINIIHCNFKRNGITIDDYNKVSRGMYYYLYRPANQPSISNKSLEQLVKETLAGVHGNGDARKASLGNQYDPVMAVINGKATAPKKTVDQLAQEVIAGKHGNGEERKKSLGPDYDVVQKRVSELLKKQPSEPSKGVEVKQPTETKISQTEPPGKAIVSKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKISGAKTFSEAVKGMFKVGGAVYDYAATGYDNYLVGMSSRLKAIEAENGALSKYDTATVTDVAKTDKIEVAIEGIEVTINGTRYRLTKDPI

SEQ ID NO: 2301 - protein, 468 aa, Streptococcus plurextorum
MPVNTETAIRWMADRKGRVTYSMDYRNGPNSFDCSSSVYFALMSAGAISAGWAVNTEYEHDWLIKNGYTLIAENADWDAQRGDIFVWGRRGQSSGAGGHTGIFIDPDNIIHCNYAHNGITIDNYNQTAAASGWMYCYVYRLASQTSATGKSLETLVQETLAGKYGNGDIRKAALGNQYEAVMAVINGKATTSQKSVDELAQEVIQGKHGNGEARKKSLDSQYDAVQKRVSEILKKQPSEPSKGAEVKQTTETKTSQNEPIEQATVTKEEGDLSFNGAILKKVVLDKILANCQKHDILPSYALTILHYEGLWGTSAVGKADNNWGGMTWTGKGQRPSGVIVTQGSARPSNEGGHYMHYGSVDDFLTDWFYLLRKDGSYKVTGAKTFSEAVKGMFKVGGAVYDYAANGFDSYIVGASSRLKAIEQENGSLAKFDKQTDISDGESDKIEVTIEGIEISINGITYELTKKPV

SEQ ID NO: 2302 - protein, 388 aa, Staphylococcus aureus
MEINTEIAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPFKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEA

SEQ ID NO: 2303 - protein, 468 aa, Streptococcus suis
MGVNIETALRWMSDRKGRVTYSMDYRNGPNSFDCSSSVYYALMYAGAISAGWAVNTEYEHDWLIKNGYTLIAENTDWDAKRGDIFIWGRRGQSAGAGGHTGIFVDPDNIIHCNYARNGITVDNYNQTAAASGWMYCYVYRLANQTSTTGKSLETLVQETLAGKYGNGDTRKAALGNQYEAVMAVINGKATASQKSIDELAQEVIQGKHGNGEARKQSLGADYPAVQKRVSELLKKQPSEPSKTQEVKQATETKTSQTEPTGQATASKEEGDLSFNGAILKKAVLDKILANCKKHDILPSYALTILHYEGLWGMSAVGKADNNWGGMTWTGQGSRPSGITVTQGSARPSNEGGHYMHYASVDDFLTDWFYLLRAGGSYKVSGAKTFSEAVKGMFKVGGAVYDYAASGFDSYIVGASSRLKAIEQENGSLAKYDTATVTDVNLSDDIEINVEGIEVIINGETYKLEKKPV

SEQ ID NO: 2304 - protein, 468 aa, Streptococcus suis
MGVNIETAIRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDQRKAALGNQYEAVMAVINGKATTNQKTVDQLAQEVIAGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRFKAIESENGTLSKYDTATVTDVGSKDHIDITIDGIEVIINGETYKLEKKPV

SEQ ID NO: 2305 - protein, 481 aa, Streptococcus suis
MAVNIEAAIAWMSARVGKVTYSMDYRNGPGSYDCSSSVYYALMSAGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLANQPTTSPSGKTLDTLVKETLAGKYGNGDQRKAALGNQYEAVMAVINGKATAPKKTVDQLAQEVIQGKHGNGEDRKKSLGPDYDAVQKRVTEILKGSPSGNTPKTPSDAPKSEVVNSSTEPKTEGTGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLADWFYLLRSGGSYKVSGAKTFSEAIKGMFKTGGAVYDYAATGYDNYLVGMSSRLKAIEAENGSLAKFDTATVTDVGSTDKIEVNIEGIEISINGVTYTLSKKPV

SEQ ID NO: 2306 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2307 - protein, 471 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTELLKKQPSEPSKAQEVKQPTETKTSQTETTEKVTVSKEDGDLSFNGAILKKAVLEKILANCKKHDILPSYALTILHYEGLWGTSAVGKADNNWGGMTWTGQGNRPSGVTVTQGSVRPSNEGGHYMHYATVDDFLTDWFYLLRAGGSYKVSGAKTFSESVKGMFKVGGAVYDYAASGFDSYIVGASNRLKAIESENGSLTRFDATSNNVHPVDPDKISVDIDGIEVTINGVVYKLEKKPV

SEQ ID NO: 2308 - protein, 468 aa, Streptococcus suis
MALNMEQAIAWMEARRGKVTYSMDYRNGPNSYDCSSSVYFALMSAGAISAGWAVNTEYMHDWLIKNGYKLIAENQDWDAKRGDIFIWGRRGQSSGAGGHTGIFIDPDNIIHCNYARNGITVDNYNQTAAASGWMYCYVYRLANQTSTSGKSLETLVQETLAGKYGNGDTRKAALGNQYEAVMAVINGKATASQKSVDELAREVIAGKHGNGEARKKSLGSQYEAVQKRVSELLKKQPSEPLKSPEVKQATESKTSQTELTGQATASKEEGDLSFNGAILKKAVLDKILDNCKKHDILPSYALTILHYEGLWGTSAVGKADNNWGGMTWTGQGQRPSGVTVTQGSARPSNEGGHYMHYASVDDFLTDWFYLLRAGGSYKVSGAKTFSEAVKGMFKVGGAKYDYAASGYESYLVGASSRLKAIESENGSLTKYDTATVTDVGSTDKIEVNIEGIEISINGVTYTLSKKPV

SEQ ID NO: 2309 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVGIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2310 - protein, 468 aa, Streptococcus suis
MGVNIETALRWMSDRKGRVTYSMDYRNGPNSFDCSSSVYYALMSAGAISAGWAVNTEYMHDWLIKNNYQLIAENVDWDAKRGDVFIWGKRGQSAGAGGHTGIFIDPDNIIHCNYARNGITVDNYNQTAAASGWMYCYVYRLGNQTSTTGKSLETLVQETLAGKYGNGDTRKAALGNQYEAVMAVINRKATASQKSIDELAQEVIQGKHGNGEARKQSLGADYPAVQKRVSELLKKQPSEPSKTQEVKQATESKTSQTEPTGQATESKEEGDLSFNGAILKKAALDKILANCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2311 - protein, 465 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPVNQPSISNKSLDQLVKETLAGVHGNGDARKASLGNQYEPVMAVINGKATTSQKTVDQLAQEVIAGKHGNGEARKKSLGSQYEAVQKRVTELLKKQPSEPSKAQEVKQPTETKTSQTEPTGNATVNKEDGDLSFNGAILKKVVLDKILANCKNHDILPSYALTILHYEGLWGTSAVGKADNNWGGMTWTGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 2312 - protein, 468 aa, Streptococcus suis
MGVNIETAIRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTSGKSLETLVQETLAGKYGNGDTRKAALGNQYEAVMAVINGKATANQKSIDELAQEVIAGKHGNGEARKKSLGGQYEAVQKRVSELLKKQPSESSKSPEVKQVTETKTSETEPTGKATVSKEEGDLSFNGAILKKAVLDKILANCKKHDILPSYALTILHYEGLWGTSAVGKADNNWGGMTWTGQGNRPSGVTVTQGSARPSNEGGHYMHYASVDDFLTDWFYLLRASGSYKVSGAKTFSEAVKGMFKVGGAVYDYAASGFDSYIVGASSRLKAIESENGTLSKYDTATATDVNQSDDIEINVEGIEVIINGETYKLEKKPV

SEQ ID NO: 2313 - protein, 468 aa, Streptococcus agalactiae
MEINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKSVLGNQYEAVMSVINGKTTTNQKTVDQLVQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2314 - protein, 468 aa, Streptococcus agalactiae
MGINTETAIAWMSARQGKVSYSMDYRDGPNSYDCSSSVYYALRSAGASSAGWAVNTEYMHDWLIKNGYQLIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAALGNQYEAVMAVINGKTTTNQKTVDQLAQEVIAGKHSNGEARKKSLGSQYDAVQKRVTELLKKQPSEPSKAQKVNKPTETRTSQTEPAEKATVSKEDGDLSFNGTILKKAVLDKILANCKKHDILPSYALTILHYEGLWGTSAVGKADNNWGGMTWTGQGNRPSGVTVTQGSARLSNEGGHYMHYASVDDFLTDWFYLLRAGGSYKVSGAKTFSEAIKGMFKVGGAIYDYAASGFDSYIVGASSRLKAIEAENGSLDKFDKATDIGDGSKDKIDITIEGIEVTINGITYELTKKPV

SEQ ID NO: 2315 - protein, 506 aa, Bifidobacterium merycicum
GGGVCVNGLPVAGICHAGRRIGLTRDGALLVPSGKNLLRWSEMTAFDGLVKTAVADFPKNRKAISSEMAFSIAPNRGGKERNLDILNKGKPAHRHARIPRRIRTPLAALAVAVSMAFAPAAMADMDGYDISNWQCGINTASVPADFVIVGTTWGSGDVYGGCLSNGVNTDANRQLAGAINSGKETGVYHYARGGNPETEARFFVDNVRGYVHKSVLILDWEAQDNAAWGDKQWPRHWAREVKRLTGVNPIIYTMDSGYWQVAGMETELNCGIWIAQYATNLVTGYQTAPWNLGARGEVMRQYTSNGSLSGWSGRLDLNRFRGDRAAWRKYANPDDKGAASLPNVRPTPQPTTAPKVDLDALATRTIRGDFGNDPARRQALGSNYAAVMAIVNRRLGGGTASTGANCGGVCVTVRAGDTLGSIAARNGGTWSQWTGYRSGNPDLIYAGETVCRRAAGSSTAIASATGGHVVRSGESLWSIYGTGWQAAAQRNGLHAPYTIYPGQHLR

SEQ ID NO: 2316 - protein, 468 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2317 - protein, 465 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPRTSNKSLDQLVKETLAGIHGNGDARKASLGNQYEAVMAVINGKTTTSQKTVDQLAQEVIQGKHGNGEDRKKSLGSQYEAVQKRVTELLKKQPSEASKAQEVKQPTETKTNQTEPTGKATASKEDGDLSFNGTILKKAVLDKILANCKKHDILPSYALTILHYEGLWGTSAVGKADNNWGGMTWTGQGNRPSGVTVTQGSARPSNEGGHYMQYASVDDFLTDWFYLLRAGGSYKVSGAKTFSESVKGMFRVGGAVYDYAASGFDSYIVGASSRLKAIESENGSLDKFDKQTVMDVAKTDKIEVAIEGIEVTINGIRYKLTKEPI

SEQ ID NO: 2318 - protein, 465 aa, Streptococcus suis
MTINLETSIRWMSDRVGKVSYSMDHRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPVNQPSISNKSLDQLVKETLAGVHGNGDARKASLVNQYEPVMAVINGKATTSQKTVDQLAQEVIAGKHGNGEARKKSLGSQYEAVQKRVTELLKKQPSEPSKSSEVKQTTETKTSQTEPIGKAIVGKEEGDLSFNGAILKKAVLEKILANCKKHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2319 - protein, 481 aa, Streptococcus suis
MAVNIEAAIAWMSARVGKVTYSMDYRNGPGSYDCSSSVYYALMSAGAISAGWAVNTEYEHDWLIKNGYKLITENQDWDAKRGDIFIWGRRGQSSGAGGHTGIFVDPDNIIHCNYANNSITINNYNQTAAASGWMYCYVYRLANQPTTSPSGKTLDTLVKETLAGKYGNGDQRKAALGNQYEAVMAVINGKAASPKKTVDQLAQEVIQGKHGNGEDRKKSLGPDYDAVQKRVTEILKGSTSGNTPKTPSDAPKSEVVNSSTEPKSEETGATGKATDTKITKEDGDLSFNGAILKKSVLDVILAKCKEHNILPSYAITVLHFEGLWGTSAVGKADNNWGGMTWTGHGNRPSGVTVTQGTARPANEGGYYMHYASVDDFLTDWFYLLRSGGSYKVSGAKTFSEAIKGMFKTGGAVYDYAATGYDNYLVGMSSRLKAIEAENGSLAKFDTATVTDVGSTDKIEVNIEGIEISINGVTYTLSKKPV

SEQ ID NO: 2320 - protein, 479 aa, unidentified
  REGION 1..479: note = Streptococcus cuniculi
MAINTDTAISWFEARKGKVSYSMDYRDGPNSYDCSSSVYYALMSAGAISAGWAVNTEYEHDWLIKNGYKLVAENQDWDSQRGDVFIWGMRGQSSGAGGHTGIFIDSDNIIHCNWGKRGISVDNYDTVAAASGWMYCYVYRLESGASTQGKSLDTLVKETLAGKYGNGDVRKAALGNQYEAVMAVINGKAAAPKKTVDQLAQEVIQGKHGNGEDRKKSLGPDYDAVQKRVTEILKGSTSGNTPKTPSDAPKSEVVNSTTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2321 - protein, 476 aa, Bifidobacterium merycicum
MPSGKNLLRWSEMTAFDGLVKTAVADFPKNRKAISSEMAFSIAPNRGGKERNLDILNKGKPAHRHARIPRRIRTPLAALAVAVSMAFAPAAMADMDGYDISNWQCGINTASVPADFVIVGTTWGSGDVYGGCLSNGVNTDANRQLAGAINSGKETGVYHYARGGNPETEARFFVDNVRGYVHKSVLILDWEAQDNAAWGDKQWPRHWAREVKRLTGVNPIIYTMDSGYWQVAGMETELNCGIWIAQYATNLVTGYQTAPWNLGARGEVMRQYTSNGSLSGWSGRLDLNRFRGDRAAWRKYANPDDKGAASLPNVRPTPQPTTAPKVDLDALATRTIRGDFGNDPARRQALGSNYAAVMAIVNRRLGGGTASTGANCGGVCVTVRAGDTLGSIAARNGGTWSQWTGYRSGNPDLIYAGETVCRRAAGSSTAIASATGGHVVRSGESLWSIYGTGWQAAAQRNGLHAPYTIYPGQHLR

SEQ ID NO: 2322 - protein, 329 aa, Agrococcus casei
MVKIRKQLIPSMQMANGTANRCEWLTIHETANTSVGANAAAHANLQAGFWPHASWHWSVDAIEAVQSYLHNRQLRHAGDGAWGTGNAHSIAIEICVNSDMSRAAARENAAQLAAKILREEGIPISRMVQHNKWSSEDKNCPTFMRANGGKLWREFVARVRALLGSPDAPAPDPKPKPPATGKKSISQLATEVLDGKWGNDPRRSQQLRAAGYDAAAVQAEVNRRLGLGGSKPTPKPAGKTISQLADEVMAGKHGNGDARKKSLGSNYNAVQAEVNRRLSGGGSGGGKSVSQLATEVLRGDWGNDPDRKRRLEAAGYNYHAVQAEVNRRI

SEQ ID NO: 2323 - protein, 418 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRL

SEQ ID NO: 2324 - protein, 470 aa, unidentified
  REGION 1..470: note = Streptococcus varani
MTINTEQAIAWMSAQAGKVTYSMDYRNGPGSYDCSSSVYYALMSAGAITAGWAVNTEYQHDWLIKNGYKLIAENKDWDAKRGDVFIWGRRGQSSGAGGHTGIFVDPDNIIHCNYARNGITIDNYNQTAAASGWMYCYVYRLSNQSSTSTAGKSLDTLVKETLAGVYGNGDTRKAALGNQYEAVMAVINGKTTAPKKSVDQLAQEVIQGKHGNGEERKQSLGADYPAVQKRVTELLKKQPSEPSNAQEVKQSTETKTSQTEPTGQATATKEEGELSFNGAVLKKAVLDKILANCKKHNILPSYAITCLHFEGLWGTSAVGKADNNWGGMTWTGNGNRPSGVTVTQGSARPSNEGGHYMHYASVDDFLTDWFHLLRAGGSYKVSGAKTFSEAVKGMFKVGGAVYDYAASGYDSYIVGMASRLKAIEQENGPLSKYDQQADISVGQSDKIDVVIDSLEITINGVTYTATKKPF

SEQ ID NO: 2325 - protein, 470 aa, unidentified
  REGION 1..470: note = Streptococcus varani
MTINTEQAIAWMSAQAGKVTYSMNYRDGPTSYDCSSSVYYALRSAGASSAGWAVNTEYMHDWLIQNGYELIAENVDWEAKRNDIAIWGERGYSSGAGGHVVMFIDADNIIHCNWARNGITIDNYNATAAASGWMYCYVYRLANQSSTSTAGKSLDTLVKETLAGVYGNGDTRKAALGNQYEAVMAVINGKATANQKTVDQLAQEVIAGKHGNGEARKKSLGSQYEAVQKRVTELLQKQSSEPSKSSEVKQSTETKTSQTEPAEKATVSKEEGDLSFNGAILKKAVLDKILANCKKHDILPSYALTILHYEGLWGTSAVGKADTNWGGMTWTGQGNRPSGVTVTQGSARPSNEGGHYMHYATVDDFLTDWFYLLRAGGSYKVSGAKTFSEAVKGMFKVGGAVYDYATSGFDSYIVGASSRLKAIEAENGSLAKFDVATVDNVGSTDKIEVNIEGIEISINGVTYELTKKPV

SEQ ID NO: 2326 - protein, 468 aa, Streptococcus suis
MTINLETSIRWMSDRIGKVSYSMDYRNGPNSYDCSSAVYYALMSAGAISAGWAVDTEYMHDWLIRNGYVLVAENKPFNAQRHDVFIWGKRGYSSGEDGHTGIFVDNVNIIHCNFKRNGITIDDYNKVSRGMYYYLYRPTNQPSISNKSLDQLVKETLAGVHGNGDARKASLGNQYEPVMAVINGKATAPKKTIDELVQEVIAGKHGNGEERKKSLGPDYDVVQKRVSELLKKQPSEPLNGQEVKQVTETKISQTEPTGQATAGKEEGDLSFNGAILKKSVLDVILAKCKEHNILPSYAITVLHFEGLWGTSAVGKADTNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIESENGSLAKYAQQTVTDVAKTDKIEVAIEGIEVTINGTRYRLTKDPI

SEQ ID NO: 2327 - protein, 483 aa, Streptococcus suis
MAANMEQAIAWMEARRGKVTYSMDYRNGPNSYDCSSSVYFALMSAGAISAGWAVNTEYMHDWLIKNGFKLISENGVFAAQRGDIFIWGRRGQSSGAGGHTGIFVDSNNIIHCNYARNGITVDGYLATARAAGNMYYYIYRPSGQAQVSSSTAGKSIDQLVQETLAGKYGNGEQRKAALGSQYQAVMAVINGKATAPKKTVDQLAQEVIQGKHGNGEDRKKSLGPDYDAVQKRVTEILKGSPSGNIPKTPSDAPKSEVVNSSTEPKTEETGANGKATDTKITKEDGDLSFNGAILKKSVLDVILAKCKEHNILPSYAITVLHFEGLWGTSAIGKTDNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2328 - protein, 481 aa, Streptococcus hyointestinalis
MAVNIEAAIAWMSARVGKVAYSMDYRNGPGSYDCSSSVYYALMSAGAISAGWAVNTEYEHDWLIKNGYKLIAENTDWDAKRGDIFIWGRRGQSSGAGGHTGIFVDPDNIIHCNYANNSITINNYNQTAAASGWMYCYVYRLANQPTTSPSGKTLDTLVKETLAGKYGNGDQRKAALGNQYEAVMAVINGKATAPKKTVDQLAQEVIQGKHGNGEDRKKSLGPDYDAVQKRVTEILKGSTSGNTPKTPSDAPKSEVVNSTTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIETENGSLSKYDVATVEDVGSKDKIEVNIDGIEISINGVTYTISKKPV

SEQ ID NO: 2329 - protein, 426 aa, Bifidobacterium pseudocatenulatum
MNILNKGKPKHKRMNPRRQRRKLLTALAVAISMAVAPAAMADMNGYDISNWQCGIDTATVPADFVIVGTTWGSGGVYGGCLSNGVNTDANRQLAGAIDSGKETGVYHYALGGNPETEARFFVDNVRGYVHRSVLILDWEAQDNAAWGDKQWPRRWAREVKRLTGVNPIIYTMDSGYWQVAGMETELDCGIWIAQYATNLVTGYQTAPWNIGARGEVMRQYTSNGSLSGWSGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2330 - protein, 471 aa, unidentified
  REGION 1..471: note = Streptococcus hillyeri
MTVNIEAAIAWMSARAGKVTYSMDYRNGPGSYDCSSSVYYALMSTGAISAGWAVNTEYEHDWLIKNGYELIAENTAWDAKRGDVFIWGRRGQSSGAGGHTGIFIDPDNIIHCNYANNGITINDYNQTAAASGWMYWYAYRLKSGASTQGKNLDTLVKETLAGKYGNGEARKAALGNQYEAVMAVINGKATASKKTVDQLAQEVIQGKHGNGEDRKKSLGPDYDAVQKRVTEILKASTSGNTPKTPSDAPKSEVVNSTTEPKKATDTKITKEDGDLSFNGAILKKSVLDVILAKCKEHNILPSYAITVLHFEGLWGTSAVGKADNNWGGMTWTGKRERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2331 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2332 - protein, 468 aa, Streptococcus agalactiae
MEINTEIAIAWMSARQGKVSYSMDYRDGPNSYDCSSSVYYALRSAGASSAGWAVNTEYMHDWLIKNGYELIAENVDWNAVRGDIAIWSMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPFKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2333 - protein, 414 aa, Bifidobacterium asteroides
MRWSHARHARAKPRYARIVVGAMAALAMLSPGVAYADAGFDNASYQGCYDARKAKESGASFSITKITEGTGYVNPSADCQLAANKAAGLRIGAYGYARPEYGNSPEEEADFFNAQSNSRGLVHAGVIPFLDWEPPAKYRGDTQWAKRWLDRVASYWGTKPIIYMSASTISAGDWRAVAGADYGLWVAGYPHGYKGERLRDPGAPPYSVAPWPFAAAWQYSSTGHVPGVGTAVDVNWWYGDAGTWSKYANAPVGTQANPATPSPTPSQGAPVGDVGSLATAVIRGEYGNDPQRRALLGNRYSEVMAVVNERLRGNSGGGTGSGTYVVRPGDCLSAVFGGSWLTVARLNGIRTPYVIHPGQRLATGSGGGGGRTVTVQRGDTLSGIAARLGIPQNRLHGYRSGNPSLIYAGETLRY

SEQ ID NO: 2334 - protein, 481 aa, Streptococcus suis
MTINIETAIAWMSARVGKVTYSMDYRNGPGSYDCSSSVYYALMSAGAISAGWAVNTEYEHDWLIKNGYKLIAENQDWDAKRGDIFIWGRRGQSAGAGGHTGIFIDPDNIIHCNYARNGITVDNYNQTAAASGWMYCYVYRLANQPTTSPSGKTLDTLVKETLAGKYGNGEQRKAALGNQYEAIMAVINGKATAPKKTVDQLAQEVIQGKHGNGEDRKKSLGPDYDAVQKRVTEILKGSTSGNTPKTPSDAPKSEVVNSSTEPETEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKVGGAVYDYAATGYDNYLVGMSSRLKAIEAENGSLTKYDTATVDNVGSTDKIEVNIEGIEISINGVTYTLSKKPV

SEQ ID NO: 2335 - protein, 424 aa, Bifidobacterium pseudocatenulatum
MSILNKGKPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDNQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2336 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSCGMYYYLYRPANQPSISNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2337 - protein, 468 aa, Streptococcus suis
MTINLETSIRWMSDRVGKVSYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDNYNQTAAASGWMYCYVYRLANQTSTAGKSLETLVQETLAGKYGNGDTRKAALGNQYEAVMAVINGQSSASQKSVDELAQEVIQGKHGNGEARKKSLGSQYEAVQKRVTELLKKQPSEPSKSSEVKQVTEAKTSQTETSEKVTASKEDGDLSFNGAILKKAVLDKILVNCKKHDILPSYALTILHYEGLWGTSAVGKADYNWGGMTWTGKGERPSGVTVTQGSARPSNEGGHYMHYASVDDFLTDWFYLLRAGGSYKVSGAKTFSEAVKGMFKIGGAVYDYAASGFDSYIVGASSRLKAIESENGTLSKYDTATVTDVGSKDHIDITIDGIEVIINGETYKLEKKPV

SEQ ID NO: 2338 - protein, 465 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHAGIFVDNVNIIHCNFKRNGITIDDYNKVSRGMYYYLYRPANQPSTSNKSLDQLVKETLAGVHGNGDARKASLGNQYEPVMAVINGKATTSQKTVDQLAQEVIAGKHGNGEARKKSLGSQYEAVQKRVTELLKKQPSEPSKAQEVKQPTETKTSQTEPTGNATVNKEEGDLSFNGAILKKVVLDKILANCKNHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKVGGATYDYAASGFDSYIVGASSRLKAIESENESLDKFDKQTVTDVGQSDDIEINVEGIEVIINGETYRLEKKPV

SEQ ID NO: 2339 - protein, 424 aa, Bifidobacterium pseudocatenulatum
MNILNKGKPKHMKPRRRWRTPLTALAVAVSMAFAPAAMADMDGYDISNWQCGIDTATVPADFVIVGTTWGSGGVYGGCLSNGVNTDANRQLAGAINSGKETGVYHYARGGNPETEARFFVDNVRGYVHKSVLILDWEAADNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRTAWRKYANPGDKGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2340 - protein, 424 aa, unidentified
  REGION 1..424: note = Bifidobacterium
MSILNKGKPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2341 - protein, 424 aa, Bifidobacterium pseudocatenulatum
MSILNKGKPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSERLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRMPASAWSVPSGNINRIWPGQQVCYGGSTASSIGAHVVTTSHVVTAGESLWKIYGSGWPAAAQRNGLRAPYTIYPGQVLH

SEQ ID NO: 2342 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYPRNGITIDNYNQVHRGMYYYLYRPANQPSTSNKSLDQLVKETLAGVHGNGDARKASLGNQYEAVMAVINGKATAPKKTVDQLAQEVIQGKHGNGEDRKKSLGPDYDAVQKRVTEILKGSTSGNTPKTPSDAPKSEVVNSSVEPKTEETGATGKATDTKITKEDGDLSFNGAILKKSVLDVILAKCKEHNILPSYAITVLHFEGLWGTSAVGKADNNWGGMTWTGKGERPSGVTVTQGSARPSNEGGHYMHYATVDDFLTDWFYLLRAGGSYKVSGAKTFSDAIKGMFKVGGAIYDYAASGFDSYIVGASSRLKAIESENGTLSKYDTATVTDVGSKDHIDITIDGIEVIINGETYKLEKKPV

SEQ ID NO: 2343 - protein, 426 aa, Bifidobacterium longum
MKTLDKSKHKHGRLHRRVGGTLAALVAVVSMAFAPAAMADMDGYDISNWQCGIDTATVPADFVIVGTTWGSGGVYGGCMSNGVNTDANRQLAGAINSGKETGVYHYAFGGDPETEARFFVDNVRGYVHKSVLILDWEEQDNAAWGDKQWPRRWAREVKRLTGVNPIIYTMDSGYWQVAGMETELDCGIWIAQYATNLVTGYQTAPWNIGARGEVMRQYTSNGSLNGWSGRLDLNKFRGDRAAWRKYANPDDKGAAGLPDVKPTPQPTTAPTVDLDALATRTIRGDFGNDPARRQALGSNYAAVMDIVNRRLGGSTGASTAVDCGDVCVTVGVGDTLSSIAVRNGGSWDQYTGYRSGNPALIYPGETVCRRTGPSVAPAYAGGGRYVVRAGDTLGGIAAYYGVNMYSIHGYRSGNPALIYPGETLYW

SEQ ID NO: 2344 - protein, 252 aa, Escherichia coli
MTINIETAIRWMTDRVGLVKYSMDYRNGPNSFDCSSSVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKPVSYTHL

SEQ ID NO: 2345 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGKRGQSAGAGGHTGIFIDSDNIIHCNYARNGITVDNYNQTAAASGWMYCYVYRLANQTSTSGKSLETLVQETLAGKYGNGDTRKAALGNQYEAVMAVINGKATVPKKTIDQLAQEVIQGKHGNGETRKQSLGADYPAVQKRVSELLKKQPSEPSKVQEVKQPTTTKTSQTEPTGKATVSKEEGDLSFNGAILKKAVLDKILDNCKKHDILPSYALTILHYEGLWGTSAVGKTDNNWGGMTWTGQGQRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGEIYKLEKKPV

SEQ ID NO: 2346 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLGQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2347 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLGQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAIFKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2348 - protein, 396 aa, Streptococcus suis
ENKPFNAQRHDVCILGKRGYSSGAGGHVVIFVDNANVIHCNYARNGITIDNYNQVHRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2349 - protein, 424 aa, Bifidobacterium pseudocatenulatum
MNILNKGKPKHMKPRRRWRTPLTALAVAVSMAFAPAAMADMDGYDISNWQCGIDTATVPADFVIVGTTWGSGGVYGGCLSNGVNTDANRQLAGAINSGKETGVYHYARGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPTVDLDALATRTIRGDFGNDPARRQALGSNYAAVMDIVNRRLSGSGVTTPSGNTGSYCVVVSSGDTMGAIASRTGRMPASAWSVPSGNINRIWPGQQVCYGGSTASSIGAHVVTTSHVVTAGESLWKIYGSGWPAAAQRNGLRAPYTIYPGQVLH

SEQ ID NO: 2350 - protein, 424 aa, Bifidobacterium pseudocatenulatum
MSILNKGKPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYALGGNPETEARFFVDNVRGYVHRSVLILDWEAQDNAAWGDKQWPRRWAREVKRLTGVNPIIYTMDSGYWQVAGMEAELDCGIWIAQYATNLVTGYQTAPWNIGARGEVMRQYTSNGSLSGWPGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2351 - protein, 426 aa, Bifidobacterium adolescentis
MNILNKGKPKHKRMNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYVHKSVLILDWEAQDNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2352 - protein, 426 aa, Bifidobacterium pseudocatenulatum
MNILNKGKPKHKRMNPRRQWRKLLTALAVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2353 - protein, 468 aa, Streptococcus agalactiae
MKINTETAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPSKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2354 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKHGYSSGEGGHTGIFVDNVNIIHCNFKRNGITIDDYNNVSRGMYYYLYRPANQPSTSNKSLDQLVKETLAGIHGNGDARKASLGNQYEPVMAVINGKATAPKKTIDELVQEVIAGKHGNGEERKKSLGPDYDVVQKRVSELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDQQTVTDVAKTDKIEVAIEGIEVTINGTRYKLTKEPI

SEQ ID NO: 2355 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDTRKAALGNQYEAVMAVINGKATSSQKSIDELAQEVIAGKHGNGEARKQSLGADYPAVQKRVSELLKKQPSEPSKTQEVKQATETKTSQTESTGQATASKEEGDLSFNGAILKKAVLDKILANCKKHDILPSHALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIESENGTLSKYDTVTVTDVGSKDHIDITIDGIEVIINGETYKLEKKPV

SEQ ID NO: 2356 - protein, 476 aa, Streptococcus suis
MTINLETSIRWMSDRIGKVSYSIDYRNGPNSYDCSSAVYYALMSGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPTNQPSISNKSLDQLVKETLAGVHGNGDARKASLGNQYEPVMAVINGKATANQKSIDELAQEVIKGKHGNGEARKQSLGADYPAVQKRVTEILKGSTSGNAPKTPSDAPKSEAVNSSTGLKTEETGATGKATESKEAGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSTDKIEVNIEGIEISINGVTYTLSKKPV

SEQ ID NO: 2357 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDICILGKRGYSSGAGGHVVIFVDNVNVIHCNYARNGITIDNYNQVHRGMYYYLYRPANQPSISNKSLDQLVKETLAGVHGNGDARKASLGNQYEPVMSVINGKATAPKKTVDQLAQEVIAGKHGNGEDRKKSLGPDYDAVQKRVTEILKGSTSGNTPKTPSDAPKSEAVNSSTETKTEEIEATGKVTEPKIVKEAGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLTKYDTATVNNVGSTDKIEVNIEGIEISINGVTYTLSKKPV

SEQ ID NO: 2358 - protein, 430 aa, Bifidobacterium longum
MGILDKCKPKHGRLHRRAGGTLAALVAALVAVVSMAFAPAAMADMDGYDISNWQCGIDTATVPADFVIVGTTWGSGGVYGGCMSNGVNTDANRQLAGAINSGKETGVYHYAFGGDPETEARFFVDNVRGYVHKSVLILDWEEQDNAAWGDKQWPRRWAREVKRLTGVNPIIYTMDSGYWQVAGMETELDCGIWIAQYATNLVTGYQTAPWNIGARGEVMRQYTSNGSLSGWSGRLDLNKFRGDRAAWRKYANPEDKGAAGLPDVKPTPQPTTSPTVDLDALATRTIRGDFGNDPARRQALGSNYAAVMDIVNRRLGGSTGASTAVDCGDVCVTVGVGDTLSSIAASNGGSWNQWTGYRSGNPALIYPGETVCRRTGPAATPAYAGGGRYVVRAGDTLGGIAAYYGVNMYSIHGYRSGNPALIYPGETLYW

SEQ ID NO: 2359 - protein, 426 aa, Bifidobacterium longum
MKTLDKSKHKHGRLHRRVGGTLTALVAAVSMAFAPAAMADMDGYDISNWQCGIDTATVPADFVIVGTTWGSGGVYGGCMSNGVNTDANRQLAGAINSGKETGVYHYAFGGDPETEARFFVGNVRGYVHKSVLILDWEEQDNAAWGDKQWPRRWAREVKRLTGVNPIIYTMDSGYWQVAGMETELDCGIWIAQYATNLVTGYQTAPWNIGARGEVMRQYTSNGSLSGWSGRLDLNKFRGDRAAWRKYANPEDKGAAGLPDVKPTPQPTTSPTVDLDALATRTIRGDFGNDPARRQALGSNYAAVMDIVNRRLGGSTGASTAVDCGDVCVTVGVGDTLSSIAASNGGSWNQWTGYRSGNPALIYPGETVCRRTGPAATPAYAGGGRYVVRAGDTLGGIAAYYGVNMYSIHGYRSGNPALIYPGETLYW

SEQ ID NO: 2360 - protein, 468 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPTNQPSISNKSLDQLVKETLAGVHGNGDARKASLGNQYEPVMAVINGKATAPKKTVDQLAQEVIAGKHGNGEERKKSLGPDYDVVQKRVSELLKKQPSEPLNGQEVKQVTETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYENYLVGMSSRLKAIESKNGTLAKYDQQTIIDVAKTDKIEVAIEGIEVTINGTRYRLTKEPI

SEQ ID NO: 2361 - protein, 414 aa, unidentified
  REGION 1..414: note = unclassified Bifidobacterium
MRWSHARHARAKPRYARIMVGALAVLAMLTPGAAYADAGFDNASYQGCYNAQAARDSGASFSITKITEGTGYVNPAADCQLAANRAAGLRIGAYAYARPDYGNSPEAEADHFNAQANARGLVHAGVIPFLDWEPPAPYNSHTDWAKRWLDRVASYWGTKPIIYMQASNIQAGNWQAVAGADYGLWVAGYPRGYVGERLRDPGAPPYSVAPWPFAAAWQYSSTGSVPGVGNAVDVNWFYGDAATWARYANAPVGTQANPVTPSPTPSQGAPVGDVGSLATAVIRGEYGNDPQRHALLGNRYDEVMAVVNERLRGSSGGGNGSGTYVVRPGDCLSMVFDGSWPMIAQLNGIRAPYIIYPGQRLATGNGGGGGRTVTVQRGDTLSGIAARLGIPQSQLHGYRSGNPSLIYAGETLNY

SEQ ID NO: 2362 - protein, 424 aa, Bifidobacterium pseudocatenulatum
MSILNKGNPKHMKPRRRWRTPLTALAIAVSMAFAPAAMADMDGYDISNWQCGIDTATVPADFVIVGTTWGSGGVYGGCLSNGVNTDANRQLAGAINSGKETGVYHYARGGNPETEARFFVDNVRGYVHRSVLVLDWEAQDNAAWGDKQWPRRWAREVKRLTGVNPIIYTMDSGYWQVAGMEAELDCGIWIAQYATNLVTGYQTAPWNIGARGEVMRQYTSNGSLSGWSGRLDLNKFRGDRAAWRKYANPDDRGAASLPNVKPTPQPTTAPKVDLDALATRTIRGDFGNDPARRQALGSNYAAVMDIVNRRLSGSGVTTPSGNTGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2363 - protein, 426 aa, Bifidobacterium pseudocatenulatum
MNILNKGKPKHKRMNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYVHKSVLILDWEAQDNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRTAWRKYANPEDKGTASLPNVKPTPQPTTAPTIDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2364 - protein, 426 aa, Bifidobacterium pseudocatenulatum
MNILNKGKPKHKRMNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYVHKSVLILDWEAQDNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPYGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2365 - protein, 430 aa, Bifidobacterium merycicum
MTTANKGTPKHAKPRRRYRQPTVALLIAACLAIAPCAMADTGIDTASYQGCWNGAQAKSSGVNFAFIKLNQGTGYVNPYATCQVSAARANGIREGAYDFASPQTSSPEAEADKFVDEARARGMVGRAIPVLDWEPSAPGGYWGKQTWWALRWVNRVKATWGVNPMIYMSAAMIPTGDWSAVVATNAGLWVAGYPRGYAGDRLRNPGSVPYSVSPWPFAAAWQYSSSGSVGGIGGAVDVNWFYGDAVTWAKYAGAPASSVTSNTTTPPKNNKTNGAPVADVNTLASAVIRGEYGNDPQRRQLLGSRYSEVMAIVNRRLAGSSGSVSGSNGGAYCVVVSSGDTMGAIASRTGRTPASAWSVPSGNINRIWPGQRVCYGGSTASNVGARTVGASHVVAAGESLWSIYGTGWQSAAARNGLHAPYTIYPGQHLR

SEQ ID NO: 2366 - protein, 468 aa, Streptococcus suis
MGVNIETAIRWMSDRKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYARNGITVDNYNQTAAASGWMYCYVYRLANQTSTSGKSLEILVQETLAGKYGNGDQRKAALGNQYEAVMAVINGKATTNQKTVDQLAQEVIAGKHGNGEARKKSLGSQYEAVQKRVTELLKKQPSEPSKVQEVKQPTTTKTSQTEPTGKATVSKEEGDLSFNGAILKKAVLDKILDNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIEQENGSLAKYDTATVTDVNQSDDIEINVEGIEVIINGETYKLEKKPV

SEQ ID NO: 2367 - protein, 257 aa, Mobiluncus sp.
MSNYQLDTSRHAACWTKGRGGHGVQYIVIHHWDDPKKHPTFEGTVSWFVSGKGRTSAHYVVEAGRVARMVAESDTAWHAGNWNYNQRSIGIECNPRASEADKQTVAQLVSELLARYPGAKLIGHKDIVATGCPGAYYPPAKALAPYLGGNPTSAPAPAPTAPAGVDVERLAREVIDGKHGNGEARKKALGANYGAVQARVNEILAGNKAPAKKKTTDQVAREVIQGQWGNGADRKKRLTQAGYNYNTIQRRVNQLLK

SEQ ID NO: 2368 - protein, 414 aa, unidentified
  REGION 1..414: note = uncultured Bifidobacterium sp.
MRWSHARHARAKPGYGRIMVGALAVLAMLTPGAAYADAGFDNASYQGCYNAQAARDSGASFSITKITEGTGYVNPAADCQLAANKAAGLRIGAYAYARPERGTSPEAEADFFNFQAQARGLVHAGVIPFLDWEPPASHRGDTQWAKRWLDRVASYWGTKPIIYMSASTISAGDWTAVAGADYGLWVAGYPRGYAGERLRDPGAPPYSVAPWPFAAAWQYSSTGHVPGVGTAVDVNWWYGDAQTWARYANAPIGTQANPVAPSPTPSQGAPVGDVGSLATAVIRGEYGNDPQRHALLGNRYDEVMAVVNERLRGNAGGGNGSGIYVVRPGDSLSAVFGGSWPTIARLNGISPPYVIHPGQRLITGSNGGGGRTVTVRRGDTLSGIAARLGIPQNRLHGYRSGNPNKIQIGEVLRY

SEQ ID NO: 2369 - protein, 468 aa, Streptococcus suis
MGVNIETALRWMSDHKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYASNGITVDNYNQTAAASGWMYCYVYRLANQTSTSDKSLETLVQETLAGKYGNGDQRKAALGNQYEAVMAVINGKTTTIQKNVDQLAQEVIAGKHGNGEARKKSLGSQYEAVQKRVTELLKKQPSEPSKAQEVKQPTETKTSQTEPTGNATVSKEDGDLFFNGAILKKAVLDKILANCKKHNILPSYALTILHYEGLWGTSAVGKADNNWGGMTWIGQGNRPSGVTVTQGSARPSNEGGHYMHYASVDDFLTDWFYLLRAGGSYKVSGAKTFSEAVKGMFKVGGAVYDYAASGFDSYIVGASSRLKAIESENGSLDKFDTQTVTDVGQSDDIEINVEGIEVIINGETYKLEKKPV

SEQ ID NO: 2370 - protein, 472 aa, unidentified
  REGION 1..472: note = Streptococcus moroccensis
MAINIETAVGWMTSRVGKVTYSMDYRNGPSSYDCSSSVCSALITAGASNPGWLLNTEYMHDWLVKNGYKLISENQDWDSKRGDIFIWGRRGQSSGAGGHTGIFVDANNIVHCNYARNGITIDNYNQTAAASGWMYVYVYRLTNSAKTTSSLGKNLDTLVKETLAGVYGNGDQRKAALGNQYEAVMAVINGKAKTNQKTVDQLAQEVIAGKHGNGDDRKKSLGSQYDSVQKRVTELLKKQTSEPSKTQEVKQTKQTKTSQSEATGNATVSKEEGDLSFNGAVLKKAFLDKILANCKKHDILPSYVLTILHYEGLWGTSAVGKVDNNWGGMTWTGQGNRPSGVTVTKGSARPSNEGGHYMHYASVDDFLTDWFYLLRSGGSYKVSGAKTFSEAVKGMFKVGGAVYDYAASGFDSYIIGASSRLKAIESENFSLTRFDATSNNVTSTNPDKISIDIEGIAVTINGVAYELTKKPV

SEQ ID NO: 2371 - protein, 424 aa, Bifidobacterium sp.
MSILNKGKPKHMKPRRRWRTPLTALAVAVSMAFAPAAMADMDGYDISNWQCGIDTATVPADFVIVGTTWGSGGVYGGCLSNGVNTDANRQLAGAINSGKETGVYHYARGGNPETEARFFVDHARGYVHKSVLILDWEAADNTAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGSNYAAVMAIVNRRLSGSGVTTPSGNTGYCVVVSSGDTMSAIASRTGRTPASAWSVPSGNINRIWPGQQVCYGGSTASSVGAHVVTTSHVVTAGESLWVIYGPSGWQAAAQRNGLSYPYVIHPGQVLR

SEQ ID NO: 2372 - protein, 472 aa, unidentified
  REGION 1..472: note = Streptococcus parasuis
MDLNMEQAIAWMEARRGKVTYSMDYRNGPNSYDCSSAVYYALMSAGAISAGWAVNTEYEHDWLLKNGFKLIAENSVFAAQRGDIFIWGKRGQSSGAGGHTGIFVDSNNIIHCNYARNGITVDRYLDVARASGNKYYYIYRPSGQSSVSSSTAGKSIDQLVQETLAGKYGNGDARKANLGNQYQAVMDRINGKTSAVQKTVDQLAQEVIAGKHGNGEARKQSLGSQYDIVQKRVSELLKKQPSEPSKSSEVKQPTATKTSQTEPIEKATVSKEEGDLSFNGAILKKAVLDKILANCKKHDILPSYAITVLHFEGLWGTSAVGKADNNWGGMTWTGKGERPSGVTVTQGSARPSNEGGHYMHYSSVDDFLTDWFYLLRAGGSYKVSGAKTFSEAIKGMFKVGGAVYDYAASGFDSYIVGASSRLKAIEAENGSLAKYDTATVTDVGQSDKIEVAIEGIEVTINGTRYRLTKEPI

SEQ ID NO: 2373 - protein, 472 aa, unidentified
  REGION 1..472: note = Streptococcus parasuis
MGVNIETAIAWMEARRGKVTYSMDYRNGTNSYDCSSAVYYALMSAGAVSAGWAVNTEYEHDWLLKNGFTLIAENSAFNAKRGDIFIWGKRGQSSGAGGHTGIFVDSNNIIHCNYARNGITVDGYLDVARASGNKYYYIYRPPAQSTIPTSTAGKSIDQLVQETLAGKYGNGDQRKAALGNQYEAVMAVINGKTTTNQKTVDQLAQEVIAGKHGNGEARKKSLGSQYEAVQKRVTELLKKQPSEPSKSSVVKQPTETKTSQTEPTEKATARKEEGDLSFNGAILKKAVLDKVLANCKKHDILPSYAITVLHYEGLWGTSAVGKADNNWGGMTWTGQGNRPSGVTVTQGSARPSNEGGHYMHYASVDDFLTDWFYLLRDGGSYKVSGAKTFSDAVKGMFKVGGAVYDYATSGFDSYIVGASSRLKAIESENGSLAKYDTATVTAVGSTDKIEVNIEGIEISINGVKYTISKKPV

SEQ ID NO: 2374 - protein, 472 aa, unidentified
  REGION 1..472: note = Streptococcus parasuis
MALNMEQAIAWMEARRGKVTYSMDFRNGPNSYDCSSAVYYALMSAGAISAGWAVNTEYEHDWLLKNGFTVIAENSAFAAKRGDIFIWGKRGQSAGAGGHTGIFVDSNNIIHCNYARNGITVDGYLDVARSSGNKYYYIYRPPAQSTVSTSTAGKSIDTLVKETLAGKYGNGDQRKAALGNQYEAVMAVINGKTSAPKKTVDQLAREVIQGKHGNGVDRKKSLGSQYEAVQNRVTELLKKQPSEPSKSSEIKQPTETKTSQTEPTEKATARKEEGDLSFNGTILKKAVLDKILANCKKHDILPSYAITILHFEGLWGTSAVGKTDNNWGGMTWTGQGNRPSGITVTQGTARPSVEGGYYMHYSNVDDFLTDWFYLLRSGGSYKVSGAKTFSDSVKGMFKVGGAVYDYAASGFDSYIVGASSRLKAIEAENGSLTKYDTATVDNVGSTDKIEVNIEGIEVSINGVKYTISKTPV

SEQ ID NO: 2375 - protein, 481 aa, Streptococcus hyointestinalis
MAVNIEAAIAWMSARVGKVTYSMDYRNGPGSYDCSSSVYYALMSAGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLANQSTPSTSGKTLDTLVKETLAGKYGNGDQRKAALGNQYEAVMAVINGKATAPKKTVDQLAQEVIQGKHGNGEDRKKSLGPDYDAVQKRVTEILKGSTSGNAPKTPSDAPKSEVVNSTTEPKKVETGTTGKATEPKIAKEVGDLSFNGAILKKSVLDIILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEITINGVTYTLSKKPV

SEQ ID NO: 2376 - protein, 481 aa, Streptococcus suis
MTINLETSIRWMSDRVGKVTYSMDYRNGPNSYDCSSAVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQLAQEVIQGKHGNGEDRKKSLGPDYDAVQKRVTEILQGSTSGNAPKLASDAPKNEVVNSSTEPKTEETRATGKATDTKITKEDGDLSFNGAILKKSFLDVILAKCKEHDILPSYALTILHYEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIEAENGSLAKYDTATVTDVGQSDKIEVAIEGIEVTINGTRYKLTKEPI

SEQ ID NO: 2377 - protein, 472 aa, unidentified
  REGION 1..472: note = Streptococcus parasuis
MSLNIEQAIAWMEARRGKVTYSMDYRNGSNSYDCSSAVYYALMSAGAVSAGWAVNTEYEHDWLIKNGFTLIAENSAFNAKRGDIFIWGKRGQSAGAGGHTGIFVDSNNIIHCNYARNGITVNGYLDVARASGNKYYYIYRPHGQSTVSASTAGKSIDQLVQETLAGKYGNGDARKTILGNQYEAVMAVINGKTTTNQKTVDQLAQEVIQGKHGNGEDRKKSLGSQYEAVQKRVAELLKKQPSEPSKSSEVKQPTGTKTSQTKPTEKATASKEEGDLSFNGAILKKAVLDKILANCKKHDILPSYAITILHFEGLWGTSAVGKTDNNWGGMTWTGQGNRPSGVTVTQGTARPSVEGGYYMHYSNVDDFLTDWFYLLRSGGSYKVSGAKTFSDAVKGMFKVGGAVYDYAASGFDSYIVGASSRLKAIEAENGSLAKYDTATVTDVGSTDKIEVNIEGIEISINGVKYTISKKPV

SEQ ID NO: 2378 - protein, 47 aa, Streptococcus agalactiae
MTNREIMIEELAQEAIGGTFGNGNERKQRLGTLYHEVQKKVNEILWR

SEQ ID NO: 2379 - protein, 384 aa, Bifidobacterium pseudocatenulatum
MDGYDISNWQCGIDTATVPADFVIVGTTWGSGGVYGGCLSNGVNTDANRQLAGAINSGKETGVYHYARGGNPETEARFFFNHVRGYVHKSVLILDWEAADNTAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRAIRGDFGNDPARRQALGSNYAAVMDIVNRRLSGSGVTTPSGNAGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2380 - protein, 444 aa, unidentified
  REGION 1..444: note = Caudoviricetes sp.
MTEMTELLVQSLQAFALYGLATISYTILSAWSNINVWKISEGFDKKLWLNGLAKYALLGASTIVIILVAKALLIFAPNWGIELQGANQISSQIIFGVLAAGIAGMVLKNIQKLAEIYGVSQKNLDKITTSALEKEDAEAPLVIDVADLPNGKKAKDADVEKAVEKSGAKALLDSGRGASVPTDSWQSFRNAVINQAFDVDGAYGAQCWDGGALFWLNAVGRTLSTGGTGAARGAWEAARGYNAGSEFELITDRNAIQPGDWLFFGGTQWGHVGMAVSNNLGGYVRLLGQNQTGNGNGAPFTEINMNLGSFLGAMRLKRWHIAPAPAPAPQPQLSPDEVAAQVIRGDWGNGDDRRARLAGAGYNPDDIQNRVNAKLSQATPAEPEAPRFSVGDIVQPKVAVDYNGTPLTQYDNNYVITELIGDRAVLSARGQVWAALNTNNLRKA

SEQ ID NO: 2381 - protein, 218 aa, Solobacterium sp.
MPNFSDQNTKATNAAKPNAENKEKKDVLHTILDAFAPKAGKPKEEAKPAAAPAQSVKPAAAPAQSVKPAASPAQFAQKPAAKPAGMPSNIPTQQKPAPKPAGMPSNIPAQQKPAAAAAPKAGLKANDVVAKEVIRGDWGNGAERKAKLEAAGYNYDAVQSEVNRQLSGKPAAPAGNLDDVARRVIRGDFGNGAERKAKLEAAGYDYNAVQARVNQLLK

SEQ ID NO: 2382 - protein, 252 aa, unidentified
  REGION 1..252: note = Bacilli bacterium
MYPIKTNNLRVTSYYGNRQYYYQGKLVKDFHNGIDLVGGQEIVAFADGTVTGVQKTGVQYGTACYVRIRHDNGWYTLYYHLKTNSIVVNVGQRVTKGQKLGIIGATGRATGVHLHFQIDKGGSSSSINPYDYVFNGKELVPASNNNTGRKSNDELANEVIRGDWGNGQDRKNRLTNAGYDYNAVQSLVNQKLGVGSKPTNNSQRTYIVQKGDTLWGIAKRYYGNGNKYPEIARANNIANPNIIHIGQKLIIP

SEQ ID NO: 2383 - protein, 312 aa, Listeria monocytogenes
MKTKGIDISTWQKPSQINYDHLAKEVDFVILRAGYTGHGTGVSLHKDDAFEKHYKAFHERGIPIGVYWYSCANTKTKGIAEANKCLEIIKGKTISYPVFIDTEDNYHQRPSGKKAISDALVGFCETVENAGYYAGIYASSSWFQDLTELDRLAPYDFWVAQWSNKEPTLRHGIWQYSSKGKLSGYSGNLDMNYAYKDYKAIIQSAGLNHLGKEENAPAPTEKKSVELLAKEVIQGLWGNGEERKKRLTDAGYNYAAVQSKVNEMLSSKKSYDAIAKEVIRGDWGNGQERKNKLTKAGYDYVSVQKRVNELLK

SEQ ID NO: 2384 - protein, 312 aa, unidentified
  REGION 1..312: note = Lactobacillus delbrueckii
MKTTGIDISTWQKPSQINYDQLAKEVDFVILRAGYTGHGTGVSLHKDDAFEQHYKAFHERGIPIGVYWYSCANTKTKGIAEAKKCLEIIKGKTISYPVFIDTEDNYHQRPSGKKAITDALVGFCETVENAGYYAGIYASSSWFQDLTELDRLSPYDFWVAQWSNKEPTLRHGIWQYTSKGKLSGYSGNLDMNYAYKDYKAIIQSAGLNHLGKEENAPAPTEKKSVELLAKEVIQGLWGNGEERKKRLTDAGYNYAAVQSKVNEMLSSKKSYDAIAKEVIRGDWGNGQERKNKLTKAGYDYVSVQKRVNELLK

SEQ ID NO: 2385 - protein, 312 aa, Listeria monocytogenes
MKTKGIDISTWQKPSQINYDMLAKEVDFVILRAGYTGHGTGVSLHKDDAFEKHYKAFHERGIPIGVYWYSCANTNAKGVAEAKKCLEIIKGKTISYPVFIDTEDNYHQRPSGKKAITDALVGFCETVENAGYYAGIYASSSWFQDLTELDRIAPYDFWVAQWSNKEPTLRHGIWQYSSKGKLNGYSGNLDMNYAYKDYKTIIQSAGLNHLAKEESTPAPTEKKSVETLAKEVIQGLWGNGEERKKRLTDAGYDYAAVQSKVNEMLSSKKSYDAIAKEVIRGDWGNGQERKNKLTKAGYDYVSVQKRVNELLK

SEQ ID NO: 2386 - protein, 254 aa, unidentified
  REGION 1..254: note = uncultured Granulicatella sp.
MVEKINETLMENSGRLVGMEFVVIHNDAGYMTPTEYIEWLRYREKSLGIAHYYCNRDTIVRVVDTYHIAYHTGDWWSNIRSIGYEVCESMKVTDEEFLQNEEMTLMQATEDLLYYGLPISTDTVRLHHEFVPTSCPHRSLALHGGTTESVKEYFVARMTELSELGSTVEEMLAAMEKQDGDVLETTEENTGGKGGETIEDLSEDNQNNPKTDDEMADEVILGLWGNGTERKQRLEEEGYDYDAIQEIVNKKLSE

SEQ ID NO: 2387 - protein, 289 aa, unidentified
  REGION 1..289: note = Bacteriophage sp.
MAAMKGIDISNWQKGFSLADASPDFVIVKATEGLGLVDKYCDGFVQDALRLNIPFGYYHFARSNDPATEARYFYDNTRGYVGKGIPILDFEVPNSNTWLETWCKAFWQLSGIRPWVYMNSDYINNRGYGTPWVKSNCGLWLAGYPQYYVSYPGSDCPYRHDGWTLAAWQFTDCLAMGGMQIDGDFFYGDRKAWNAYAGTDGTGDSSDGMVPGPTVLELATDTIKGRYGNGADRRTALGSRYDEVQEKINDLYTKANNVIKGRYGDGTDRRDELGDEYGIVQYIVNNMLK

SEQ ID NO: 2388 - protein, 417 aa, unidentified
  REGION 1..417: note = Bombiscardovia nodaiensis
MRNTSPRHASGIKVKEPSKAMPIVTGGLATLVASAALASPAVAATANGDGSFKVERGDTLSQIASTFGDGKWSGWTGFRSGNPNLIFPGEDVRPGDGAAATTSDLKDLAKRVLKGEFGNGQARRTALGDKYDSVQAIVNQMLGAPAAATARAGSTSVNPASQPARNASSKSQQWVIDKPAYDETITDKAAWTETVHHPAGTKEEKHPAQTHTVHHDAVTHQEVKHHEATTTTKHIDATYRTVHHDAVTHTEKIYEYPPSHWITINAPVSEGQYIYNTFFDDGHVSYSREDEDAYMRAHPLVSFTTDFCYFATAEDAAKSEIRRLVADSLGQIITDKIVVDKPAWDEQVLVTPARDETVPVPAWDETVTITDKPAWDETIVDKAEWSEQVAVPAWDEQVQHPAQTHTVHHDEVGHWAR

SEQ ID NO: 2389 - protein, 285 aa, unidentified
  REGION 1..285: note = Bacteriophage sp.
MSQKIIDVSEHNGKINWQRVKDAGYHAIIRLGYGQESSKQRDKYAVNNVQECERLGIPYGLYIYSYADTKQKAYGEANHAINFILNFCGKNFKYPCFYDVEETRISRIARENSLIFCRELVKAGYKTGVYANENWWLTILRDDFDIAYYRWVAKWSKNKPDVSGVSLWQYTDRDKIPGITGNVDCSFSYFDIKETSESNQYVSVDQLADKVEAGEFGNGEDRKKALGNKYDVVQLIVNLRKGSKAGLNKVVNQVINGDYGNGETRKINLGEAWSIVQREVNKKLK

SEQ ID NO: 2390 - protein, 348 aa, unidentified
  REGION 1..348: note = Caudoviricetes sp.
MKGIDISNWQKGIDLAAVPCDFVIAKATQGTGYTSPDCVRQVEQAMSLGKKVGVYHYIGGQGAVAEMDFFIDSIKNWVGKVMIVLDWEQGKNAAWGSLGYLEQCIARVKERTGVPPVVYASASVFPWDLCRKHNCGTWVAQYANNNATGYQDAPWNEGKYGCMMRQYSSHGRLPGYGGNLDLNKFYGDAAAWDRYANPEGAAQPAPQPAPQPTAPQGSTLELADRLMRNEFGSGDARKQALGSRYGEVQNFINHIASASVDILASEVMAGKYGNGDVRKRVLGSRYKAVQDKINGASKPAPQRVYVVKPGDTLSGIAQKYGTTYTKLAQMNGISNPNKIYTGQKIRVR

SEQ ID NO: 2391 - protein, 481 aa, Streptococcus suis
MGANMQQAIAWMEARRGKVTYSMDYRNGPNSYDCSSSVYFALMSAGAISAGWAVNTEYMHDWLIKNGFKLIAENSVFAAQRGDIFIWGRRGQSSGAGGHTGIFVDSNNIIHCNYARNGITVDNYLATARASGNMYYYIYRPSGQSAVSTSTAGKSIDQLVQETLAGKYGNGEQRKAALGNQYQAVMDLINGKTSAPQKTDEELAREVLAGKHGNGEDRKRSLGSRYEAVQKKVDELLKKPAAPQPSPQPSPQPAPKVEAPKVETPKVETPKQEPAPVQFREDGDLSFNGAILKSEVLKKILAKCKEHDILPSYALTILHYEGLWGTSAVGKADNNWGGMTWTGQGNRPSGVTVTQGSARPSNEGGHYMHYASVDDFLTDWFYLLRAGGSYKVSGAKTFSDAVKGMFKVGGAAYDYAASGFDNYIVGASSRLKAIESENGSLDKFDKLTDTDVGQSDDIEVNVEGIEVIINGETYKLEKKPV

SEQ ID NO: 2392 - protein, 83 aa, unidentified
  REGION 1..83: note = Bacilli bacterium
SRYSEVQAKVNEMLAGNSKPSTPTPTPQPSVDILDLVRKTIRGDFGNGETRKQKLGSNYNEVQRQVNLNLKAGLTQWDKIKLF

SEQ ID NO: 2393 - protein, 142 aa, unidentified
  REGION 1..142: note = Prevotellaceae bacterium
MSTISKTTSSAVGLSGNTPKKKSKWWLWLIILLVIVVIVILALKKCQNETKTQTPTPEVPAVVADTTAGKSEISDSISLDTDSTDSPQPTSQSTDNYDELAKIVVRGNYGNDPQRKNSLGDNYQEVQKRVNQGKGVWWMPIE

SEQ ID NO: 2394 - protein, 367 aa, unidentified
  REGION 1..367: note = Arthrobacter phage LilHuddy
MVLPITGINEQFNAVFFTEGPTQKDGIVIHWWGLPQGQTIQSVRDTFGNGGRQASAHYGCSDGVVDCYVNPDDVAWANGHWGANLSKISIECDPRQSDGDYYAAAWTVAYIRSIYGDLPLSRHDQYYATQCCGTYDINRIDRLARTIDVKSVSKPTPAKPAPAKPAVPATKGKTIAQLAEEVLKGAYGTGDARRLALGAQFQAVQDEVNRRLSGAANPKPKPNISALADQVLAGKFGNGDQRITALGVNYQAVQDEVNRRANAKPAAKPAAKPAPKPAAKPVVTVVNISDLVRRTLNGEFGNGDERKRRLGANYQAVQNAINAGAQPNINDLVARTLRGDFGDGDERKRRLGLNYSAVQAEINRRYS

SEQ ID NO: 2395 - protein, 241 aa, Enterococcus saccharolyticus
MSVNIETVIKYMYDLRARGIRYSMTGSRTGKDGTGDCSGTIYQGLRNGGATNAGWVLNTDSMHSWLVKNGFDLIAQNKEWTAKRGDIVIFGLKGQSGGAAGHVVIFISNTQIIHCTYKSATANGVYVDNEATTCPYDMGWYVYRQKGSNKPTTSKTIEQLAQEVLQGLHGNGEARKKSLGSNYAAVQKRVDALASSRKKSINTIAKEVINGTWGNGDARINKLKAAGYDPVAVQKRVNQLI

SEQ ID NO: 2396 - protein, 355 aa, unidentified
  REGION 1..355: note = uncultured Collinsella sp.
MAMNGIDISNWQKGIDLAAVPCDFVIAKATQGTGYTSPDCVRQVEQAMSLGKKVGVYHYIGGQGAVSEMDFFIDSIKNWVGKVMIVLDWEQGENRAWGNLGYLEQCIARVKERTGIPPVVYASASVFPWDLCRKHNCGAWVAQYADNNPTGYQDAPWNEGKYGCMMRQYSSHGRLPGYGGNLDLNKFYGDPTAWDKYANPNGAAQPQPAPQPQPDPQPTAPQGSTLELADRLMRDEFGSGDARKQALGSRYGEVQDFINHIASASVDTLAAEVMAGKYGNGDMRRRVLGTRYKAVQDKINGASQPAPQRVYTVKPGDTLSGIAQKVGWGGNWRGLANKNGIKNPNVIYAGQKIYY

SEQ ID NO: 2397 - protein, 224 aa, unidentified
  REGION 1..224: note = Prevotellamassilia timonensis
MTEDKSKRKSTRKFNLEKHVKRSFNLEKEGAATPAPSAEAPATPQPAPAPTPAPAGGGDATQTGNGGNKGKHVLSLVVGLAVVAAIGFAAFRGCNSNSSQPVDEPVVDTVMDEQPTAPTDSTQRADSTQLGGGDQNAPADAPNEVQPQDETVNAATPSAQPETSTPSTPSATKAATPSKDVDAEVQKVLRGDYGNGQERKDKLGSSYTKIQRAVNRYYRSKGLL

SEQ ID NO: 2398 - protein, 405 aa, Streptococcus phocae
MTVDTEKAIDWMRSKEGQVSYSMQYRNGPNSYDCSSAITSALIYAGAEHPGWLLNTEYMHDWLVEIGYELISENQDWESQRADIAIWGVRGQSAGAGGHVVMFIDSENIIHCNYLYNNITVNNYNETAAASGWMYSYAYRYKGATDKNVGTKTIDELAKEVLAGLHGSGEQRKISLGANYDAVQSKVNGLLKEPKIAEESPAVKQEGDLLFNGAVLKKVVLDKILAKCKEHDILPSYAITVLHFEGLWGQSTVGRVDNNWGGMTWTGQGERPSGVVVTQGQARPSNEGGHYMHYNSVDDFLKDWFYLLRPGGSYKVSGAKTFSEAVKGMFQAGGAKYDYAATGYENYLVGMSSRLKAIEQENGTLDKFNERADIATEQADKIDVVIDSIEITINGITYTATKKPV

SEQ ID NO: 2399 - protein, 361 aa, unidentified
  REGION 1..361: note = Lacticaseibacillus absianus
MTNFFVADVSSHDTIDAAALPQIGAVIIKATQGTTYVNPKCNGQYAAAKAAGKKLGLYHYAAGGDPVAEADYFISNINNYVGEALLAVDWEGYQNAAYGKNSNWVKQFVTRVHDLTNQWCLLYTGAEGARECANVKDLCGLWFAGYPYYPGTQRMYPTFEVPAKFPYSTAPWPTYTMWQFTSSDGTKDMSISNMPIESWDKFIGKAIAPVPNPVPAKTVAQLATEVIAGKYGSGDARKAALGSQYAAVQAEVNRQLGSKTASKPAAPKPATTTGKQEGVWYAQTGSFTITDSSGIKLRSGSASVSAPLLAVLAKGSVVKYNAYGYFGGYVWIRQPRSGGYGYLPTGTASGTKRTSYWGNFK

SEQ ID NO: 2400 - protein, 349 aa, unidentified
  REGION 1..349: note = Bacteriophage sp.
MKIIQMLCPSSKYNIKCPYSMEAEGICIHNTANDAPAINEIKYMISNNKETSFHFAVDDIQAVQGLPLDRNGWHASDGGNGRGNRKTIAIEICYSKSGGDRWLKALDNAAELTAELLIDHGWDISRVSKHQDYGNHKHCPHRILDEYGWDNFLNLIKSKMGKSTETETKTDEAVNSGKTVVTLAREVIAGRWGNGAQRKANLTAAGYDYAEIQGAVNDICAGKSVADRVATCTKSTPAPAPAPTPAQPAAPAKKSNDEIAKEVIAGKWGNGADRKARLEAAGYNYTAVQNIVNGLAGKPTHTTPARKSNEAIAREVIAGKWGNGNQRKQRLTAAGYNYAAIQRLVNRMI

SEQ ID NO: 2401 - protein, 307 aa, unidentified
  REGION 1..307: note = Caudoviricetes sp.
MEFPMISGQHSDFFNALAPIVCNEWVKRRRNSERTISPAVAMAQAALESGYNINASSLFGIKGEGFTSPTEEYIDGIKQNIVDSFVKYPSITASIVGYYDLMQDDNYADATAANTVEGELYGLTNAVDEGYDANGNWVGYNYATDPEYYSKCLWIVNEYGLRAYNDYVWDVVNDDNTSSEPVEQPSTEIDENVVDAIYRGEYGDGDERKERLEAEGYNYADYQARVEEKYYSNSDDTDSTPTESEPVTLTEGTKVRFTGACDTNGTPLAYTDRTYTINSFSDDREKVLLDIYGEHYAWVWASEVVPA

SEQ ID NO: 2402 - protein, 413 aa, unidentified
  REGION 1..413: note = Bifidobacterium sp. B4142
MRLSHARHARAKPRYARIGIGVLAVLAMLTPGVAWADAGFDNASWQGCYNAQAARDSGASFSITKITEGTDYVNPAADCQLQANRAAGLRIGAYGYARPERGNSPEAEADFFNAQAQARGLVHAGVIPFLDWEPPASQRGNTAWAKRWLDRVASYWGTKPIIYMSASTISAGDWRAVAGADYGLWVAGYPRGYTGERLRDPGAPPYSVAPWPFAAAWQYSSTGHVPGVGTAVDVNWWYGDAQTWAKYANAPIGTQPNPVSPSPTPAQGAPVGDASSIATAVIRGEYGNDPQRHALLGNRYDEVMAVVNERLRGHGGGTGSGVYVVRPGDSLSAVFGGSWPTVARINGLRAPYTIYPGQRLSTGGGHGGGRSVTVRPGDTLSGIAARLGIPQSRLHGYRSGNPGLIYPGETLNY

SEQ ID NO: 2403 - protein, 428 aa, unidentified
  REGION 1..428: note = Bifidobacterium sp. ESL0790
MARNRAAPRHKSGSYYARHKIERLRRDVKRLAVATVVALGLTVTPAALADAGFDNASWQGCYSAGQARAAGASFSITKLTEGPGYENEYAGCQIATNREAGLRMAAYDFAQNGLYTATASADNFTRVAQKYGLVHAGVIPVLDWEPAGNLKRDVGWAKTWLDRVQSEWGVKPLIYMSANTIQMADWTPVAGADYGLWVAGYPRGYQGERLRDPGPPPYDLGPWGFAAAWQYSSSGLVPGVGTAVDVDWFYGDAVTWSKYADAPVGSAQNPVYQTPDPSQVRPAQGAPTADGNTLADEVIRGEFGNDPTRRQLLGSRYDEVMAIVNRRMGHTGSSGGYYVVKPNDYLSKIWPQNWRSVASLNGISWPYTIYPGERIYTGGASSWDHSVRVRPGDTLSAIAARLGISPSQIHGYRSGNPNLIYPDEVLTY

SEQ ID NO: 2404 - protein, 57 aa, unidentified
  REGION 1..57: note = Caudoviricetes sp.
MIKAITLPGTFGAAIMVIAGEYGTGSERKKKLETEGFNYTEVQKCVNELLPILNKYA

SEQ ID NO: 2405 - protein, 224 aa, unidentified
  REGION 1..224: note = Caudoviricetes sp.
MNELQRFIANYNNQYLNTDGAYGAQCWDLFDKFCQDYNINVSRYCAITGYVPDLFYLFDDYGYSEYFDKINVDNLQVGDWCFWDYGNMRHVALKVGADTYFSQNPNPSQVITLSPVGLIGGMRPKLSNWTSEVSHASMEETNLYTLAIDVLNGLYGNGEERINRLGTVYNAVQSKVNEYYNDTDYFISCVADMVIRGEFGNGEERINKLGCIYQQVQDEVNSRY

SEQ ID NO: 2406 - protein, 383 aa, unidentified
  REGION 1..383: note = Bifidobacterium pongonis
MLAAPAAMASMNVIDVSGWQSSDVTRVVDADAAVVKITEGTGYTNPYWKTQIDWARSTGKACGGYHYADGGSAVAEADRFVSVFGSYVGQCVLALDWEGGGNAAWGNGAWAQTFVQRVYDRTKVWPIVYVQASAVNQITAYTRKHCMLWKAQYASMNATGWQSLPWNAGSHGEGMVQYSSTGYLNGVGPLDLNLFFGEREAWQKIAVGDRGKTKTEIRKDPVTPKVDTAPDYEAMATKVIRGDYGNGEARRTALGANYTRVMEAVNRRLGLGSAGTASTATATGGGVSAVVRSGDTMSAIAARYNRHPVTAWRVPSGNINLIYPGQTVTYGGTAATTAPAATGGHVVRAGESLWSIYGTGWQAAAQRNGLRSPYTIYPGQRLI

SEQ ID NO: 2407 - protein, 431 aa, Bifidobacterium boum
MTTANKGTPKLAKSRRRYRQPTIAFLIAACLAIAPCAMADTGIDTASYQGCWDGAQAKSSGVNFAFIKLNQGTGYVNPYATCQVNAARANGIREGAYDFASPQTSSPEAEADKFVAEARARGMVGRAIPVLDWEPSAPGGYWGKQTWWALRWVNRVKSTWGVNPMIYMSAAMIPTGDWSAVVATNAGLWVAGYPHGYMGDRLRNPGSVPYSVSPWPFAAAWQYSSSGAVGGISGAVDVNWFYGDAVTWAKYAGAPASSVTSNATTPPTNNKTNGAPVADANTLASAVIRGEYGNDPQRRQLLGGRYTEVMAIVNRRLAGSSGSMSGNNGGAYCVVVSSGDTMGAIASRTGRTPASAWSVPSGNINRIWPGQRVCYGGSTASSVGAHVIGTSHVVTAGESLWTIYGAAGWQAAAQRNGLSYPYIIHPGQVLR

SEQ ID NO: 2408 - protein, 408 aa, unidentified
  REGION 1..408: note = Bifidobacterium pongonis
MTDNRRRRIPARAARIVACAATALAMLAAPAAMASMNVIDVSGWQSSDVTRVVDADAAVVKITEGTGYTNPYWKTQIDWARSTGKACGGYHYADGGSAVAEADRFVSVFGSYVGQCVLALDWEGGGNAAWGNGAWAQTFVQRVYDRTKVWPIVYVQASAVNQITAYTRKHCMLWKAQYASMNATGWQSLPWNAGSHGEGMVQYSSTGYLNGVGPLDLNLFFGEREAWQKIAVGDRGKTKTEIRKDPVTPKVDTAPDYEAMATKVIRGDYGNGEARRTALGANYTRVMEAVNRRLGLGSAGTASTATATGGGVSAVVRSGDTMSAIAARYNRHPVTAWRVPSGNINLIYPGQTVTYGGTAATTAPAATGGHVVRAGESLWSIYGTGWQAAAQRNGLRSPYTIYPGQRLI

SEQ ID NO: 2409 - protein, 290 aa, unidentified
  REGION 1..290: note = Caudoviricetes sp.
MMKIKGVDLSYCQEGISFPALKQAGVRFAIIRAGFSTKKDVTMDKFVADCKNYGIDYGFYWYSYAMSIEQAQAEAEKCIEVIKNLSPTYPVFFDMEEKKQISGLNTDTRTKMAIAFCEKIRQAGVKPGVYANPFFMENYYDKSRIVGKYDIWLAHWTESQDKPSKYDYGQTMWQWGLDKIDGYDIDGDICFFDYAKSAPEKKTVDELADEVIAGKWDNGAERERLLTAAGYDYNAVQKRVNEILNKKTVDEIANEVIRGEWGNGAERKKRLTAAGHDYSEVQRKVNQLIK

SEQ ID NO: 2410 - protein, 309 aa, unidentified
  REGION 1..309: note = Caudoviricetes sp.
MTNIELANKLKDIAQNYKTLYVMGCFGAPMTAANKRRYTQNHSYNKQASRTAMINAASTETFGFDCVCLIKGVLWGWNGNRTATYGGAKYACNGVPDIGADSMINVCKNNSTDFSKIEVGEAVWMSGHIGVYIGDGLAVECTPKWANKVQITACNCSKSGYNRRNWTKHGKLPYITYVQQTTPVTPAKPETPSPDATFKKGDLVKITGTKYYSGKTVPLWVRLKKWYVLEGGSKRVVIDKSEDGKNSICSAVSADCLQLVKSTSSKSVDELAREVINGKWGNGSARKKKLTAAGYDYDAVQKRVNELMK

SEQ ID NO: 2411 - protein, 309 aa, unidentified
  REGION 1..309: note = Caudoviricetes sp.
MTNIELANKLKDIAQNYKTLYVMGCFGAPMTAANKRRYTQNHSYNKQASRTAMINAASAETFGFDCVCLIKGVLWGWNGNRTATYGGAKYACNGVPDIGADSMINVCKNNSTDFSKIEVGEAVWMSGHIGVYIGDGLVVECTPKWANKVQITACNCSKSGYNRRNWTKHGKLPYITYVQQTTPVTPAKPETPSPDATFKKGDLVKITGTKYYSGKTIPLWVRLKKWYVLEGGSKRVVIDKSEDGKNSICSAVSADCLQLVKSTSGKSVDELAREVINGKWGNGSARKKKLTAAGYDYDAVQKRVNELMK

SEQ ID NO: 2412 - protein, 65 aa, unidentified
  REGION 1..65: note = Lachnospiraceae bacterium
MSGINNIMQSKLNAAKNIPDKSLDEIAKEVIRGNYGNGEERKKKLAEAGYDYAQVQARVNELMKK

SEQ ID NO: 2413 - protein, 312 aa, unidentified
  REGION 1..312: note = Eubacteriaceae bacterium
MVSQARAWLGKKEADGSHKEIIDVYNSHKPLARGYAVTYSDAWCAAFVSAVAIKCGVTDVLPTECSCGQMIALFRKLGEWVENDAYIPSPGDVIFYDWQDSGSGDNTGWPDHVGIVEKVSGDTITVIEGNKNSAVSRRTLQVNGKYIRGYGVPKYSGSASPAPAVSAKSVDKLAREVLEGKWGNGNDRKKRLTAAGYDYGAVQTRVNELSRQQSKSVEELAKEVLTGKWGNGDDRKNCLTAAGYDYYAVQAKVNALLKKQEATPVYYIVKSGDTLSGIATRYGTTVSAIQRLNPTLIKNVNLILTGWKIRVK

SEQ ID NO: 2414 - protein, 187 aa, Ruminococcus sp.
MSSAYNDRDKKSEDNAAKLAAALLKKYNLSIDNLYTHTYWLNVRDGKSGSVDYLNTAKNTYKMCPLYILPHWSAFKAKVQSYMNSGTSAATTPTTTQLYRVRKRWSDVKSQIGAFSSLENAKNACKSGYSVFDANGNAVYPAKKSIDEIAREVIQGKWGNGTDRKSRLTNAGYDYNAVQKRVNELMK

SEQ ID NO: 2415 - protein, 304 aa, Ruminococcus sp.
MAILKPDKNTTLGGVTVNEYLLTKHNPNHIAMPSVSMEGKIIGVTIHNTDWISVASGTTPAEQYTRATVNGNMNDVRVHYYVDNTCAWQNLPLTLSGWHAADGSGNGNRRTIAIECIMSSAYSDRDKKSEDNAAKLAAALLKKYNLSIDNLYTHTHWLNVRDGKSGSVDYLNTAKNTYKMCPLYILPHWSAFKAKVQSYMNSGTSAATTPTTTQLYRVRKSWNDAKSQIGAFSSLENAKNACKSGYYVFDVNGNVVYPARKSIDEIAREVIQGKWGNGADRKNRLTNAGYDYNAVQKRVNELMK

SEQ ID NO: 2416 - protein, 162 aa, unidentified
  REGION 1..162: note = Prevotellaceae bacterium
MGLNPQPKKKSRWWIWLLPAVAAIAIAIFCFKKCSTTPAGDFATAAPPDTIKVAEDAAAVAAAAKAAEAAKAAEAAATAQSAAAAAGGSADSKAASATPSQAPATTPSASADRLTDAKKAIRGDFGNGYSRQRALGSKYAKVQSLVNKNLREGNHLWDDIVE

SEQ ID NO: 2417 - protein, 269 aa, unidentified
  REGION 1..269: note = Peptoniphilus nemausensis
MSNSPLVQATILSPNHSGRRNQKITKIAIHHAAGVINGRNLAGVFVPRSRRASANYNLGSDGVIVLGVDESNRAWTTSSSWCDNRAVTIEVGNSTRGPQWLVSDYVLNRLIDLVTDICRRNGIYPCTYTRGKDGVLQKHEWYKSTNCPGPYLGSKFPYIASEVNKRLRGNKTVIKPTGGLYRVRKSWSDVKSQKGAFRNFDNAKRCADRFGLKVFDANGKIVYPVGKTIDQLAREVIRGDWGNGEERKRKLTNAGYDYYVIQKRVNKLI

SEQ ID NO: 2418 - protein, 304 aa, unidentified
  REGION 1..304: note = uncultured Romboutsia sp.
MNKIGIDVSSHDGNINWNSVKDNIDFAILRIGWIGNNENQIDEKFERNYNECKRLNIPIGVYVYNYVKTEARIKECADWVVGLLKNKSLELPIYLDMEDNSLTSLGKTNLTNLCIAFNTETEKAGYWAGVYANLNWYNNYLNKDEIKRRYTTWIAHYGVNQNRYNGEYDILQYSDKGKISGVEGDVDLNTMYRDLIKDISESTTETPEQNKLPIEEVAMKVINGEYGNGEERKQKLEAEGYNYNEVQSKVNEIINANKKIIYTVKSGDTLSEIAKKYNTTVQTLVRKNNISNPNKIYVGQKIEI

SEQ ID NO: 2419 - protein, 304 aa, unidentified
  REGION 1..304: note = uncultured Romboutsia sp.
MNKIGIDVSSHDGNINWNSVKDNIDFAILRIGWIGNNENQIDEKFERNYNECKRLNIPIGVYVYNYVKTEARIKECADWVVGLLKNKSLELPIYLDMEDNSLTSLGKTNLTNLCIAFNTETEKAGYWAGVYANLNWYNNYLNKDEIKRRYTTWIAHYGVNQNRYNGEYDILQYSDKGKISGVEDYVDLNTMYRDLIKDISESTTETPEQNKLPIEEVAMKVINGEYGNGEERKQKLEAEGYNYNEVQSKVNEIINANKKIIYTVKSGDTLSEIAKKYNTTVQTLVRKNNISNPNKIYVGQKIEI

SEQ ID NO: 2420 - protein, 401 aa, unidentified
  REGION 1..401: note = Caudoviricetes sp.
MAGRAQRTYTKDLRIRTKRKQALLNYCKAYGSSIGNLDMQLGFLWQELQGYSGVMKVLKNAKSVREASDAILLQYERPADTSELVQIKRTTYGGAFYDEYAEKKESEVKTMKNTEFVAKLKDIAVNYKTLYVMGCFGAPMTDANKQRYCNNHDYNKQAARTAMIKAASADTFGFDCVCLIKGVLWGWNGDTSAAYGGATYASNGVPDIGADAMVEKCSEASTDFSSIEVGEAVWLKGHIGVYIGNGLAVECSPTFANKVQITAVKNIGDKAGYSGRAWTKHGKLPYITYEAGAQPAEPTPAPASKSVDEVAREVIKGSWGNGAERKRRLEAAGYNYGKVQARVDELCKQPEQPKPALKSAEEVAKEVLSGDWGNGAERKKRLEAAGYNYGEVQARVNELCK

SEQ ID NO: 2421 - protein, 288 aa, unidentified
  REGION 1..288: note = Bacteriophage sp.
MNNKEFADKLKNIATNYKTLYVMGCFGAPLTAANKKRYINNGSAGGYNARADRKAMINAASADTFGFDCVCLIKAVLWGWNGDKNKNYGGAGYAVNGVPDISADAMIEKCKNLSTNFTTLEIGEAVWCKGHIGVYIGNGLAVECTPSWKNKVQITSCNCTKSGYNRRNWAKHGKLPYITYVTATTGSSTAQKSSKSIDEIAREVIAGKWGNGDTRKNKLTAAGYNYAAVQKRVNELCKQPTQTKKTVDEIAREVIAGKWGNGTTRKNKLTAAGYNYTAVQKRVNELLK

SEQ ID NO: 2422 - protein, 284 aa, unidentified
  REGION 1..284: note = Oscillospiraceae bacterium
MAYTNSSLATVKILSPNHSGQRNHIIDTITIHCVVGQTSAKTLGEIFLPTSRQASSNYGIGFDGEIGLYVEEKNRSWCTSSASNDHRAITIEVASDTTEPYAVTDKAYAALLDLVTDICKRNGIKKLVWSNDKNDRVNHKNGCNMTVHRDYANKSCPGKYLYDRHPAIAAEVNKRLSGNATTDKNTKEDKVMYRVQIGAFSVKANAENMLKKAKAAGFTDAFITTTGTTAQKVETTTPALKSIDEIAKEVINGKWGNGEERKKKLTAAGYNYAKVQARVNELCK

SEQ ID NO: 2423 - protein, 96 aa, Butyrivibrio sp.
MKGQTGRGVFTVVEVQNGWGKLRNGTGWIYLEEKAYCTVLDRLISESYERKSIDEIAREVVNGKWGNGEERKMRLTEAGYDYNAVQQRVNEIIWNP

SEQ ID NO: 2424 - protein, 333 aa, unidentified
  REGION 1..333: note = unclassified Butyrivibrio
MNFVESIMTQNPCYTEGRKITVKGLMLHSVGCAQPRAMAFINSWNTPSHDSSCVHGFIDGNDGTVYQTLPWNHRGWHAGGAANNTHIGVEMCEPASLNYTSGATFTCSNIPEARKSVKRTYEAAVKLFAMLCKLFNLDPLGDGVIVSHNEGHIRGIASNHSDPEHLWNQLETGYTMDGFRKAVKELLDKGVADFPKGSTEEAYPYAGPAGTYPPVPFSVKVLIDNLNIRANPNFGGAIKGQTGRGVFTVVEVQNGWGKLRNGTGWIYLEEKAYCTVLDRLISESYERKSIDEIAREVVNGKWGNGEERKMRLTEAGYDYNAVQQRVNEIIWNP

SEQ ID NO: 2425 - protein, 367 aa, unidentified
  REGION 1..367: note = Solibaculum mannosilyticum
MEIVNGIVQDASIGGIPLVSKIVSPKGTHNVRTLKPLSTSNGNPYYIVVHNTGNSASSADARAHYSWLQGVENNDFSYVSVHFFVDEDEVVQTCPVTEITYHAGDGSTGKGNSQGLSIEICENHNYPQAEENAIQVIRAFMDHYGIPIDRVQPHRYFAPNKKLCPHLILKSESAWQTNWASFQQRIQGADVAPDDDTQSPAKSVDEIAQEVIAGKWGNGSERRERLTAAGYDYSTVQARVNEIMGGGSASATPSKTVDEVAQEVIAGKWGNGSERKDRLTAAGYDYSTIQARVNELMGGSSGGSSSNSIAVGDTVRITCNTYSTGQSIPSWVKSQTHKVSQIKGDKALLGYPDGIASWVPLSGIVRA

SEQ ID NO: 2426 - protein, 249 aa, unidentified
  REGION 1..249: note = Romboutsia ilealis
MSYKGIDVSHYDGNINWRIVKEHIDFAILRLGWIGNTHHELDTKFEIYYNECKREGIPIGIYVYNYCNTPETAKIGANWAVNHLKGKHIDLPVYIDMEDISIEHLGRKTLTDICIAFNKVIQDAGYWAGVYANLNWYTNYLNKDIIKERYTTWIADYGVSEDRFEGQYDMLQYSETGRVPGISSNVDMNIMYRDLINEIKGSNPGTDKKTIEELAKEVIAGQWGNGEERKTRLTNAGYDYAAVQAKVNE

SEQ ID NO: 2427 - protein, 99 aa, unidentified
  REGION 1..99: note = Bacteroides caecimuris
MSFVEKDSRKSVDEIAKEVISGAWGNGEARKSALEQAGYNFSEVQKRVNVLVKTTKSSIDAIAREVIAGKWGNGQDRKNRLSQAGYDFAAVQKRVNELS

SEQ ID NO: 2428 - protein, 166 aa, unidentified
  REGION 1..166: note = uncultured bacterium
TELDRLAPYDFWVAQWSSKEPTLRHGIWQYTSKGKLNGYSGNLDMNYAYKDYKAIIRSAGLNHLGKEENIPAPTEKKSVETLAKEVIQGLWGNGEERKKRLVDAGYDYVAVQSKVNEILSSKKSIDTIAKEVIRGDWGNGQERKNKLTKAGYDYISVQKRVNELLK

SEQ ID NO: 2429 - protein, 312 aa, unidentified
  REGION 1..312: note = Podoviridae sp. ctdKF3
MKKYGLDLSTHNGNVNFNTLKNNGNDFVIIRAGYGSGENQKDGRFEEYYKQAKAHGLKVGAYLYSYALNTSQALDEAKQFCKWLKGKQFDLPVYIDMEDADQYKQKHGMPSNATLSAICETFCNYMETQGYYVGIYASESWLKNQLKEVVSKNKYDLWCANWGTNDGTLQSDKSSVYNLHQFTSMYTLSGKRFDRNVMYYDYPSLIKSKGFNGYSSKPEESNKTVEQLADEVIQGKWGNGAERVTRLTQAGYDATAVQNKVNEKLGVKAKSIDTLAREVIQGKWGNGQDRKDRLTKAGYDYNAIQKRVNEML

SEQ ID NO: 2430 - protein, 242 aa, unidentified
  REGION 1..242: note = Caudoviricetes sp.
MAYTNSKMVSYTRLSPNHSGKRTHSIDRITPHCVVGQCSVETLGNIFAPRSRQASCNYGIGPDGRVGMYVEEKNRSWCSSSNANDQRAVTIECASDTKHPYAMNNKVYGSLIKLCTDICKRNGKKKLLWLGSKSKALNYKPKSDEMVLTVHRWFANKSCPGDWLYSRLGDLAKKVTANLSGTSAVKKDTPSEKKNSGTKSVDQVAREVIQGKWGNGTDRKKRLTAAGYNYNAVQKRVNELLK

SEQ ID NO: 2431 - protein, 278 aa, unidentified
  REGION 1..278: note = Caudoviricetes sp.
MGGQLQGREGERHRGRCILLRRTEMRERHRRESGRRKVLIQLLKGKQLEYPVFMDNEAQPASAKAGITEATIAFCETMETAGYFVGIYGSTDSGFRERMDDSKLTAYTHWVAQYSSKCTYAGSYGIWQYSSTGRVSGISGNVDMDLSYVDYPATITGGGFNGYTKGTTTGSTPSATPAKKSVDEIASEVIAGKWGNGDDRRNRLTAAGYDYNAVQAKVNEKLGAAAKTTAVYHTVKRGDTLSAIASKYGTSVSAIQKLNSSLIKNVNLIQIGWKIRVK

SEQ ID NO: 2432 - protein, 315 aa, unidentified
  REGION 1..315: note = Caudoviricetes sp.
MSNSPLVSYTKLSPNHSGRRTHAIDRITPHCVVGQCSVETLGNIFAPTSRQASCQYGIGVDGRVGMYVEEKNRSWCSSSNENDQRAVTIECASDTTHPYAFKDVVYNKLIELCVDICKRNGKKKLLWLGDKTKTLNYNPAADEMVLTVHRWFANKSCPGDWMYSRMGDLASKVTAKLGGSSASNPGTSGGNVLYRVQTGAFSNKANADAMLSKVNAAGFDTYMVKVDNLYKIQVGAYSNKANADAMAAKLKAAGFDTYITTKSGTAVSSVAKKSVDELAREVIQGLWGNGQDRKNRLQAAGYDYNAVQKRVNELL

SEQ ID NO: 2433 - protein, 285 aa, unidentified
  REGION 1..285: note = Caudoviricetes sp.
MSYTNSKLVSYTKISPNRNINRNHKIDTVSIHCVVGQCSVETLGSIFASRDKEASSNYGIGYDGRIGMYVEEKDRSWCTSSASNDNRAITIEVASDTYHPYRVNDVAYKSLIKLLVDICKRNSIKRLVWSTNKSERMNHLNGCNMTVHRDYANKSCPGDYLYNLHGQIAKEVNAQLGLGSSKPVTSKKALYRVRKSWKDAKSQKGAFYDLSNAKKCADKNNGCSVFDESGKVVYTPKSSGKKSVDAIAKEVIQGKWGNGTDRKNRLTKAGYDYNAVQKRVNEILS

SEQ ID NO: 2434 - protein, 336 aa, unidentified
  REGION 1..336: note = Caudoviricetes sp.
MAKVFLSPSEQFNNAYAWGNTTEGVQCGKIANACKSALERCGISVKLQHEGTMASKCQASDAFGADLHVCIHTNACNGKVSGTRMFCHDASGKGMKACRAIFSVLAPLTPGKSENISVNPQLYEIRVPNAPTAYIECEFHDVPSVAKWIVEHTTDIGEAIAHGICNYFGIAYKTKSEPAPAPKPAPTPAPSKDELYRVRKSWADAASQIGAYRVLNNAIKACKAGYSVFDSKGNVVYPKVAPAKKSIAVIAQEVIEGKWGNGQDRKNRLTAAGYNYDEVQNYVNKLLSAPAKKSIDEVAREVIAGKWGNGADRKNRLTAAGYDYNAVQKRVNEILG

SEQ ID NO: 2435 - protein, 289 aa, unidentified
  REGION 1..289: note = Caudoviricetes sp.
MKIKGVDLSYCQEGISFPALKQAGVKFAIIRAGFSTKKDVTMDKFVADCKIHSIDYGFYWYSYAMSVEQALTEAEKCIEVIKNLSPTYPIFFDMEEKKQISGLSTDTRTKMAIAFCEKIRRAGFKPGVYANPSFMENYYDKSRIVGRYDIWLAHWTNSPNCPSKYNYGQTMWQWGVDKIGGYDVDGDICFTDYSRKKPVEKTIDQLADEVLAGKWDNGAERERLFTAAGYDYNAVQKKVNEKLYRKTTDEIAVEVIAGLWGNGSARKEKLTEAGYDYSEVQKRVNEMLG

SEQ ID NO: 2436 - protein, 243 aa, unidentified
  REGION 1..243: note = Bacteriophage sp.
MSMPKVFLSPSNQYDNRYAYGDTTEGVQCGKIAEACKSALERSGVTVKMMHDESMQEKCAASNAFGADLHVPIHTNAFNNQVRGTRMFCFSSSGEGMKACQAIFNRLAPITPGTSENIRVDASLYEVRVPSAATAYIECEFHDSVESAKWIINHTGYIGETIARGICDYFGVTFREKEQAQPSKSVDEVAREVIRGEWGNGSDRRQRLEAAGYDYNAVQNHVNAILTGDEPEQPAEPAPAEPT

SEQ ID NO: 2437 - protein, 285 aa, unidentified
  REGION 1..285: note = Bacteriophage sp.
MSYTNSKLVSYTKISPNKNINRNHKIDTVSIHCVVGQCSVETLGSIFASRGKEASSNYGIGYDGRIGMYVEEKDRSWCTSSASNDNRAITIEVASDTYHPYKVNDKAYKSLIKLLVDICKRNGIKRLVWSTNKSERMNHLNGCNMTVHRDYANKSCPGDYLYNLHGQIAKEVNAQLGLGSSKPVTSKKTLYRVRKSWKDAKSQKGAFYDLSNAKKCANKNSGYSVFDESGKVVYTPKSSGKKSVDAIAREVIQGKWGNGADRKNRLTKAGYDYNAVQKRVNEILS

SEQ ID NO: 2438 - protein, 328 aa, unidentified
  REGION 1..328: note = Caudoviricetes sp.
MSNSSLVNMTILSPNHSGKRSQAITKIAIHHTAGSVSAQTIGEMFKSPLRKASCNYGIGNDNKIVMCVDEANRSWCTSSAWCDNQAVTIEVANSRNGGNWPVSDKVLSTLIELVTDICKRNGINNCSYTGGKDGVLQKHEWYKNKVCPGPYLGSKFTYIASEVNKRLHGGSSASPVAQGSSLYRVRKSWSDAKSQKDAFRNLENAKKCANANPGYSVYDANGNSVYPVASAPSKSVDTLAREVLAGNWGNGGDRVNRLTSAGYDYNAVQERVNEILSGSGAKIGVKSIDTIAREVIQGQWGNGQDRKNRLERAGYDYNAVERRVNELL

SEQ ID NO: 2439 - protein, 279 aa, unidentified
  REGION 1..279: note = Caudoviricetes sp.
MSNSPLVSYTKLSPNHSGQRTHAIDRITPHCVVGQCSVETLGNIFAPTSRQASCQYGIGVDGRVGMYVEEKNRSWCSSSNENDQRAVTIECASDTTHPYAFKDVVYNKLIELCVDICKRNGKKKLLWLGDKTKTLNYNPAADEMVLTVHRWFANKSCPGDWMYSRMGDLASKVTAKLGGSSASNPGTAGGNVLYRVQTGAFSNKANADAMAAKLKAAGFDTYITTKSGTAVSSTAKKSVDELAREVIQGLWGNGQDRKNRLQAAGYDYNAVQKRVNELL

SEQ ID NO: 2440 - protein, 301 aa, unidentified
  REGION 1..301: note = Caudoviricetes sp.
MYGIDISKHNGNINLEPYKGQFVIIRVGYGHFHLDEKFERNVNECKRLGIPFGVYHYSYALNEADAEAEARGVLNAISKYKNDIKVGVWFDMEDADGYKKKHGFKFSNSTIAPICYKFCKMIEDAGYYSGIYTSSSWLGYVKGLNDRFDKWVANWGKNDGSQHTNTSQNGTIQQYTSKPLDKNIMYADISRYSRGNTTQAKPQSKPIDQIADEVIAGQWGNGEDRRNRLTQAGYDYNAVQKAVNQKMNAKKQPAHVYYVVKRGDTLSGIASKYGTTWKKLQAMNGIRNPNKIYAGQRLRVK

SEQ ID NO: 2441 - protein, 506 aa, unidentified
  REGION 1..506: note = Caudoviricetes sp.
MREQKVRTNNMAYTNSKMVAYTKLSPNHSGQRTHSIDRITPHCVVGQCTAEGLGDWFAKSSTQASSNYGIDKNGRVGLYVEEKNRSWCSSSNANDQRAVTIECASDTKEPYWMNDKVYQSLIKLCADICKRNGKKKLIWFGDKNKTLNYSPKSDEMVLTVHRWFANKSCPGNWLYARLGDLASKVTAQLGGKADTPVTGTQASVFANLTEAQAVAKIGELCRNDMKTSGILASISAAQFILESGYGKSELAQKANNCFGMKKSLSGNTWTGSTWDRKSIYTKKTQEQNKDGSYETITADFRKYPSVEKSVADHSAYLLGAKNEDKLRYAGLKGCTDYKKAAQLIKDGGYATSLTYVEKLCSIIEKWNLTQYDKQTAAAPSAKFPAVPFSVKVIIDDLNYRSEPSMNGKVNGQTGKGTFTIVEVRDGWGRLKSGAGWIYLENPSYCMIGTVVKSASTAKTSPAKSVDTLAREVLQGKWGNGTDRKNRLTAAGYNYSAVQKRVNELLK

SEQ ID NO: 2442 - protein, 317 aa, unidentified
  REGION 1..317: note = Caudoviricetes sp.
MAIKGIDVSHWQGNIDWVKAKASGVRFAIIKAGGSDDGFYTDSKWEANYKDAKANGIAVGAYYFVGPKCVNATAGKADAERFIQLLKGKQLEYPVFMDNEAQPASAKAGITEATIAFCETMEAAGYFVGIYGSTNSGFRERMDDSKLTAYTHWVAQYASKCTYAGSYGIWQYSSTGRVSGINGNVDMDLSYVDYPSAIKNGGFNGYAKGTTTGGTPAATPAKKSVDEIASEVIAGKWGNGDNRRNRLTAAGYDYNAVQAKVNEKLGASAAYHTVKRGDTLSAIASRYGTSVSAIQKLNGSLIRNVNLIQVGWKIRVK

SEQ ID NO: 2443 - protein, 288 aa, unidentified
  REGION 1..288: note = Caudoviricetes sp.
MAKVFLSPSNQYDNRYAYGDTTEGVQCGKIAEACKAALERSGVTVKLMHDESMQEKCQASNAFGADLHVPIHTNAFNGTVSGTRMFYYAEGGEGQKACQAIFARLAPVTPGTSENIRADASLYEVRVPAAPTAYIECEFHDNPTASKWIVENTGLIGETIARGICDYFGVTFREKEQAQPAKSVDEVAREVIRGEWGNGSDRRQRLEAAGYDYNAVQNHVNAILTGDEPEQPAEPAPAEPTEPTPEPEQPTTDKLCRVQVGAFANRENAERMLRRLRDAGFDGYIREG

SEQ ID NO: 2444 - protein, 289 aa, unidentified
  REGION 1..289: note = Caudoviricetes sp.
MKIKGVDLSYCQEGISFPALKQAGVKFAIIRAGFSTKKDVTMGKFVADCKKYGIDYGFYWYSYAMSVEQAEAEAKKCISVIKGLSPTYPVFFDMEEKNQISGLNTDTRTKMAIAFCEKIMQAGFMPGIYANPSFMENYYDKSRIVGKYDIWLAHWTNSPDCPSSFSYGQTMWQWGLDRIGGYDIDGDICFCEYSKPAPEKKTVEQLADEVLAGKWDNGAERERLLTAAGYDYNAVQKRVNEKLYKKTVYEIAVEVIAGLWGNGAERKEKLTEAGYDYSEVQRRVNLLIK

SEQ ID NO: 2445 - protein, 274 aa, unidentified
  REGION 1..274: note = Caudoviricetes sp.
MSNSSLVSYTKLSPNCDHPRDHAIDKITIHHMAGDLSVETCGNLFANSSYEASSNYGIGSDGRVGLYVDEGDRAWASASPSNDNRAVNIEVANCATGGDWPVSNAAYSKLIDLCVDICQRNGIKALNYTGDADGNLTEHRMFVATACPGPYLHERMGRIAAEVNSRLSAQPAKSVDEVAREVIRGEWGNGSDRRQRLEAAGYDYDTVQNHVNAILTGDAPEQPAPAEPVEPAPEQPATDKLYRVQVGAFAVRENAEKMLQRLKDAGFEGYIREG

SEQ ID NO: 2446 - protein, 312 aa, Listeria monocytogenes
MKTKGIDISTWQKPSQINYDHLAKEVDFVILRAGYTGHGTGVSLHKDDAFEQHYKAFHERGIPVGVYWYSCANTKAKGIAEAKKCLEIIKSKTISYPVFIDTEDNYHQRPSGKKAITDALVGFCETVESAGYYTGIYASSSWFQDLTELDRLEPYDFWVAQWSSKEPTLRHGIWQYTSKGKLSGYSGNLDMNYAYKDYKAIIQSAGLNHLGKEENIPAPTEKKSIETLAKEVIQGLWGNGEERKKRLTDAGYDYVAVQSKVNEMLSSKKSIDAIAKEVIRGDWGNGQDRKNKLTNAGYDYISVQKRVNELLK

SEQ ID NO: 2447 - protein, 312 aa, Listeria monocytogenes
MKTKGIDISTWQKPSQINYDHLAKEVDFVILRAGYTGHGTGVSLHKDDAFEQHYKAFHERDIPVGVYWYSCANTKAKGIAEAKKCLEIIKSKTISYPVFIDTEDNYHQRPSGKKAITDALVGFCETVESAGYYTGIYASSSWFQDLTELDRLEPYDFWVAQWSSKEPTLRHGIWQYTSKGKLSGYSGNLDMNYAYKDYKAIIQSAGLNHLGKEENIPAPTEKKSIETLAKEVIQGLWGNGEERKKRLTDAGYDYVAVQSKVNEMLSSKKSIDAIAKEVIRGDWGNGQDRKNKLTNAGYDYISVQKRVNELLK

SEQ ID NO: 2448 - protein, 312 aa, Listeria monocytogenes
MKTKGIDISTWQKPSQINYDHLAKEVDFVILRAGYTGHGTGVSLHKDDAFEQHYKAFHERGIPVGVYWYSCANTKAKGIAEAKKCLEIIKSKTISYPVFIDTEDNYHQRPSGKKAITDALVGFCETVESAGYYTGIYASSSWFQDLTELDRLEPYDFWVAQWSSKEPTLRHGIWQYTSKGKLSGYSGNLDMNYAYKDYKAIIQSAGLNHLGKEENIPAPTENKSIETLAKEVIQGLWGNGEERKKRLTDAGYDYVAVQSKVNEMLSSKKSIDAIAKEVIRGDWGNGQDRKNKLTNAGYDYISVQKRVNELLK

SEQ ID NO: 2449 - protein, 312 aa, Listeria innocua
MKTKGIDISTWQKPSQINYDQLAKEVDFVILRAGYTGHGTGVSLHKDDAFEQHYKAFHERGIPIGVYWYSCANTKTKGIAEANKCLEIIKGKTISYPVFIDTEDNYHQRPSGKKAISDALVGFCETVESAGYYAGIYASSSWFQDLTELDRLAPYDFWVAQWSSKEPTLRHGIWQYTSKGKLNGYSGNLDMNYAYKDYKAIIRSAGLNHLGKEENIPAPTEKKSVETLAKEVIQGLWGNGEERKKRLVDAGYDYVAVQSKVNEILPSKKSIDTIAKEVIRGDWGNGQERKNKLTKAGYDYISVQKRVNELLK

SEQ ID NO: 2450 - protein, 312 aa, Enterococcus faecalis
MKTKGIDISTWQKPSQINYDHLAKEVDFVILRAGYTGHGTGVSLHKDDAFEQHYKAFHERGIPVGVYWYSCANTKAKGIAEAKKCLEIIKGKTISYPVFIDTEDNYHQRPSGKKAITDVLVGFCETVESAGYYTGIYASSSWFQDLTELDRLEPYDFWVAQWSSKEPTLRHGIWQYTSKGKLSGYSGNLDMNYAYKDYKAIIRSAGLNHLGKEENIPAPTEKKSIETLAKEVIQGLWGNGEERKKRLTDAGYDYVAVQSKVNEILSSKKSIDTIAKEVIRGDWGNGQERKNKLTKAGYDYISVQKRVNELLK

SEQ ID NO: 2451 - protein, 290 aa, unidentified
  REGION 1..290: note = Lachnospiraceae bacterium MD308
MAYTNSSMVSYTRLSPNHSGQRTHSIDRITPHCVVGQLSAESICGCFTSPSRQASCNYGIGTDGKVSLCVEEKNRSWCSSSNANDQRAVTIECASDKTEPYAMNARVYDSLVKLCTDICRRNGKKKLLWLGDRNKTLNYTPKPDEMVLTVHRWFANKSCPGSWLYARLGDLAAKVTAALGSSSASKPAADKKQLYRVRKTWADSKSQKGAFSVLANAKKCADSNKGYSVFNEDGRKVYPADLSTTKKSVDTIAREVIRGDWGNGDERKKKLIAAGYDYSAVQKRVNELLK

SEQ ID NO: 2452 - protein, 312 aa, Listeria innocua
MKTKGIDISTWQKPSQINYDQLAKEVDFVILRAGYTGHGTGVSLHKDDAFEKHYKAFHERGIPIGVYWYSCANTKTKGIAEAKKCLEIIKGKTISYPVFIDTEDNYHQRPSGKKAITDALVGFCETVESAGYYAGIYASSSWFQDLTELDRLAPYDFWVAQWSSKEPTLRHGIWQYTSKGKLSGYSGNLDMNYAYKDYKAIIRSARLNHLGKEENAPAPTEKKSVELLAKEVIQGLWGNGEERKKRLTGAGYDYAMVQSKVNEMLSSEKSIDIIAKEVIRGDWGNGQERKNKLTKAGYDYISVQKRVNELLK

SEQ ID NO: 2453 - protein, 312 aa, Listeria innocua
MKTKGIDISTWQKPSQINYDMLAKEVDFVILRAGYTGHGTGVSLHKDDAFEKHYKAFHERGIPIGVYWYSCANTNAKGVAEAKKCLEIIKGKTISYPVFIDTEDNYHQRPSGKKAITDALVGFCETVESAGYYTGIYASSSWFQDLTELDRLEPYDFWVAQWSSKEPTLRHGIWQYTSKGKLSGYSGNLDMNYAYKDYKAIIQSAGLNHLGKEENIPAPTEKKSIETLAKEVIQGLWGNGEERKKRLTDAGYDYVAVQSKVNEILSSKKSIDTIAKEVIRGDWGNGQERKNKLTKAGYDYISVQKRVNELLK

SEQ ID NO: 2454 - protein, 305 aa, unidentified
  REGION 1..305: note = Clostridia bacterium
MAYTNSKLVNYTKLSPNHSGQRNHVIDTVSIHCVVGQCSVETLGAIFADPNKEASSNYGIGYDGKIGMYVEEKNRSWCTSSATNDNRAITIEVASDTYEPYRVNAAAYKSLINLLVDICKRNGIKKLVWSTNKTDRINHKNGCNMTVHRDYANKSCPGDYLYNLHGQIAAEVNKQLGTTTTTTTSKTATTKTVNYTVKVPTALNIFAGAGTNYKVTGKCPVGVYTIVAESSGTGAKLFGKLLSGAGWIVLDHCTKVNTTAKKTIDEIAREVIQGKWGNGDERKRKLTAAGYDYDKVQAKVNELLK

SEQ ID NO: 2455 - protein, 247 aa, unidentified
  REGION 1..247: note = Clostridia bacterium
MIKIALSAGHGLNTLGNRCLKTLDKNETREWQLNARICGRVEELLKEYNGYELIRTDDISGKKDVTLISRVSKANKFKADIYISVHHNAGIKGGNGGGIMAFTYTKVDEATKSWQKDLYDALIKYTSLSGNRANPLSQANFYELKATSMPAVLLELGFMDSKTDVPIILSDSFADGCAKAIVEVIVKKGNLQKNTEEKPIFTGKSIDELAREVIKGLWGNGSERKKRLSDAGYDYLAIQARVNQLLK

SEQ ID NO: 2456 - protein, 174 aa, Solobacterium sp.
MPSFGSSNGNSGSKAGMPTNIQPQASATKETTTMKSMDTIVQEVIRGEWGNGAERKQRLEAAGYSYEVVQGKVNRELASIKSLDEVAAEVIRGAWGNGAERKQRLEAAGYNFNQIQSLVNAKLSGGTASASSLDEVAKKVIRGEFGNGAERKQRLEAAGYDFNAVQARVNQLLK

SEQ ID NO: 2457 - protein, 180 aa, Solobacterium sp.
MGLKDLFKKQEKVVEEVKEEVKETAKEVKEAIKPVASFKGGKEVSDRIEPVASFKGGQELKNEADRIKAEAQAAVAGAKDKVKELEEIATRVIRGEFGNGEERKAALEKAGFNYDEVQAKVNEVLSGVKTTAEAAAKTVEDIAKEVIRGDWGNGEERKAALEKAGYKFEEIQAKVNELLK

SEQ ID NO: 2458 - protein, 312 aa, Listeria monocytogenes
MKIKGIDISTWQKPSQINYDHLAKEVDFVILRAGYTGHGTGVSLHKDDAFEQHYKAFHERGIPVGVYWYSCANTKAKGIAEAKKCLEIIKGKTISYPVFIDTEDNYHQRPSGKKAITDALVGFCETVESAGYYTGIYASSSWFQDLTELDRLEPYDFWVAQWSSKEPTLRHGIWQYTSKGKLSGYSGNLDMNYAYKDYKAIIRSAGLNHLGKEENIPAPTEKKSIETLAKEVIQGLWGNGEERKKRLTDAGYDYVAVQSKVNEILSSKKSIDTIAKEVIRGDWGNGQERKNKLTKAGYDYISVQKRVNELLK

SEQ ID NO: 2459 - protein, 486 aa, unidentified
  REGION 1..486: note = Streptococcus equi subsp. zooepidemicus SEZ_19-037
MLHSVGCSQPRASAFINSWNSPTFDRACVHGFIDGNDGTVYQTLPWNHRGWHCGSSINGSGNNTHIGVEMCEPACITYTGGATFKCSDVATAKAVAERTYRAAVELFAMLCKEFNLEPLADGVVISHKEGHARGIASNHGDPEHLWSQLGMGYTMDTFRKAVKEQMGGKADTKKGTQASVFAGLSEKDAIPIIGELCREDMKKSGVLASVSAAQFILESGYGKSELGQNANNMFGMKKSLSGNTWAGSTWDGTSVYTKKTQEQHTDGTYETITADFRKYPCVEDSVADHSAYLLGAKNGRSLRYKGIKGMTDYKAVAQIIKEGGYATSLTYVEKLCNIIEKWNLTQYDVTDAPAPKPSTPDSVTEFPATPFSVKVIIDDLNYRSEPSMNGKVNGQTGKGTFTIMEVKNGGWGRLKSGAGWIWLSNPTYCTVGKTVKITEDKKKSIDELAKEVIRGDWGNGTERKEKLTAAGYDYASIQKRVNEILK

SEQ ID NO: 2460 - protein, 192 aa, Ruminococcus sp.
MKFQDISCNYGIGTDGRVLLCVEEKNRSWCSSSNANDQRAITIECASETYAPYVMNSKVYNKLIKLCIDICKRNKEKKLLWFKDKNKSLSYKPKPDEMVLTVHRWFANKSCPGDWLYSRLGNVAKEVTKALNTSKKKESKSKETTTEKKSIDTIAREVINGKWGNGADRKKRLTKAGYDYNAVQKRVNELLR

SEQ ID NO: 2461 - protein, 238 aa, Ruminococcus sp.
MSNSKLVNYKKLSPNHSGKRTHKIDRITPHCVVGQCSVETLGSIFMDRNREASCNYGIGTDGRVLLCVEEKNRSWCSSSNANDQRAITIECASDTYSPYAMNSKVYNKLIKLCIDICKRNKKKKLLWFKDKNKSLSYKPKPDEMVITVHRWFANKSCPGDGLYSRLGNVAKEVTKALNTPNKKGTKSKETTTKKKSIDSIAREVINGKWGNGADRKKRLISAGYDYNAVQKRVNELLR

SEQ ID NO: 2462 - protein, 293 aa, Eubacterium sp.
MEKIKGVDISYCQEGISFDELKKAGVKFAIIRAGFSTKKDVTMDKFIADCKAYDIPYGFYWYSYAMSVDETKSEAEKCVEVIKGLSPTYPVFFDMEEKRQIDGLNNEIRTEMAIAFCEVVKNAGFVAGVYANPSFMECYYDKSRLVGKYDIWLAHWTNSPDIPSRYDYGQTMWQWGIDKIGGYKIDGDVCFVDYDDKKPQTAKKTVDEFAAEVISGKWGNGDERKSRLTAAGYDYYAVQKRVNEMLCGKKSVDAVAREVICGDWGNGAERKKRLIAAGYDYSEVQKRVNELLK

SEQ ID NO: 2463 - protein, 167 aa, Clostridium innocuum
MIKAELGTSTTTTPSDTKSIDEIAKEVINGKWGNGDDRKNRLTAAGYNFGAVQAKVNEMLGATATPAPKPSKSIDQLAEEVIAGAWGNGDDRRKRLTAAGYDYSAIQAKVNQKLGGGSSAPSRKSNETIAKEVINGDWGNGSDRKNRLEAAGYNYNTIQSIVNKMLS

SEQ ID NO: 2464 - protein, 312 aa, Clostridium innocuum
MKKYGLDLSTHNGNVNFNTLKNNGNDFVIIRAGYGSGENQKDGRFEEYYKQAKAHGLKVGAYLYSYALNTSQALDEAKQFCKWLKGKQFDLPVYIDMEDADQYKQKHGMPSNATLSAICETFCNYMETQGYYVGIYASESWLKNQLKEVVSKNKYDLWCANWGTNDGTLQSDKSSVYNLHQFTSMYTLSGKRFDRNVMYYDYPSLIKSKGFNGYSSKPEESNKTVEQLADEVIQGKWGNGAERVTRLTQAGYDATAVQNKVNKKLGVKAKSIDTLAREVIQGKWGNGQDRKDRLTKAGYDYNAIQKRVNEML

SEQ ID NO: 2465 - protein, 225 aa, Bifidobacterium longum
MDNEAQPASAKAGITEATIAFCETMETAGYFVGIYGSTDSGFRERMDDSKLTAYTHWVAQYSSKCTYAGSYGIWQYSSTGRVSGISGNVDMDLSYVDYPATITGGGFNGYTKGTTTGSTPSATPAKKSVDEIASEVIAGKWGNGDDRRNRLTAAGYDYNAVQAKVNEKLGAAAKTTAVYHTVKRGDTLSAIASKYGTSVSAIQKLNSSLIKNVNLIQIGWKIRVK

SEQ ID NO: 2466 - protein, 274 aa, unidentified
  REGION 1..274: note = Bacilli bacterium
MPDFSGESFSAAITDDPSGKEILSKRGVPLGAYWYSCANTPLEGIAEAKELLRLVKGKTFSYPLVMDVEDQHHQAPTSKQVLTDTVIAFWQTIEKAGYYAMIYSSTWWLHNELDLARLAPYDIWAAQWSVSEPAVRHGIWQYTSDGNVKGYNGRLDCNYAYKDYPKIMRENGLNGLRKTATSSSPQKNVEGLAKEVIAGKWGNGNERREKLQANGFDYDAVQDRVNQILSKKTIDKIAKEVIRGDWSNGEERKKRLIEAGYDYDKVQKRVNELM

SEQ ID NO: 2467 - protein, 82 aa, unidentified
  REGION 1..82: note = Oscillospiraceae bacterium
CPGDWLYSRLGNVAKEVTKALNTPNKKGSTSKENTTKKKSIDSIAREVINGKWGNGADRKKRLISAGYDYNAVQKRVNELLR

SEQ ID NO: 2468 - protein, 63 aa, Ruminococcus sp.
ALNTPNKKGSASKENITKKKSIDTIAREVINGKWGNGADRKKRLLSAGYDYNAVQKRVNELLR

SEQ ID NO: 2469 - protein, 312 aa, Erysipelothrix rhusiopathiae
MKTKGIDISTWQKPSQINYDQLAKEVDFVILRAGYTGHGTGVSLHKDDAFEQHYKAFQERGIPIGVYWYSCANTKAKGIAEANKCLEIIKGKTISYPVFIDTEDNYHQRPSGKKAISDALVGFCETVESAGYYAGIYASSSWFKDLTELDRLAPYDFWVAQWSSKEPTLRHGIWQYTSKGKLSGYSGNLDMNYAYKDYKAIIQSAGLNHLGKEENAPTPTEKKSIDTLAKEVIQGLWGNGEERKKRLTDAGYDYTMVQSKVNEMLSSKKSIDTIAKEVIRGDWGNGQERKNKLTKAGYDYISVQKRVNELLK

SEQ ID NO: 2470 - protein, 257 aa, unidentified
  REGION 1..257: note = Gardnerella swidsinskii
MSKKGIDVSEWQGDIDFNAVKASGVEFVIIRAGYGIGCKDKWFEQNYRKAKTAGLDVGAYWYSYANSGFEAAEEAQSCVNMLSGKSFEYPVYFDLEEKSQLNRGRVFCDSLITSFCNKLEACGYYAGFYTSLSTANNLVSSHVRNRYALWIAQWNTHCDYQGSYGLWQYSSSGSVPGVAGRVDMDYAYVDYPSIIKNAGLNGCKNGGSDQAARTSSIDEVAREVINGAWGNGSTRKQRLTSAGYDYDTVQKRVNELL

SEQ ID NO: 2471 - protein, 242 aa, Dorea formicigenerans
MAYTNSKMVSYTRLSPNHSGKRTHSIDRITPHCVVGQCSVETLGNIFAPRSRQASCNYGIGPDGRVGMYVEEKNRSWCSSSNANDQRAVTIECASDTKHPYAMNDKVYASLIKLCTDICKRNGKKKLLWLGSKPKALNYKPKSDEMVLTVHRWFANKSCPGDWLYSRLGDLAKKVTANLSGTSAVKKDTPSEKKNSGTKSVDQVAREVIQGKWGNGTDRKKRLTAAGYNYNAVQKRVNELLK

SEQ ID NO: 2472 - protein, 285 aa, Clostridium innocuum
MSNSSLVSYKRLSPNHSGRRTHSIDRITPHCVVGQCSIETLGNIFAPTSRQASCNYGIGTDGRVGMYVEEKNRSWCSSSNANDQRAVTIECASDTKHPYTMNSTVYAALIKLCVDICRRNGKRKLIWLGDKNKTLNYSPKSDEMVLTVHRWFANKSCPGDWLYSRLGDLAAKVTAQLGGSSLGGGNVSGLYRVRKSWSDAKSQKGAFKSLENAKRCAKANPGYSVFDANGKVVSGNFSSSTKTLDEIAREVIKGKWGNGTDRKNRLTKAGYNYSAVQKRVNELLK

SEQ ID NO: 2473 - protein, 333 aa, unidentified
  REGION 1..333: note = Coprococcus eutactus
MASNKTPLKGYMDGIDISAWQDTIDITKVPCDFVIVKATEGTDYKNRFFAKHCDQVMKAGKLLGAFHYANGGDPHSEAEYFLAYSKKYVGKAILVLDWEGQNNPQFGRSDRAWCKEWCDYVYRKTRVKPLIYIQKSAMDNVKNLGYRLWVAQYPDYEQTGYQEHPWNEGQYDCSIRQYTSVGRLPGYEGNLDLNKSYIDKVTWRKCAAIKTDSDNGKTKGKGSDSNSGKSNDKNNKNRKKKSIDVIAKEVIAGRWGNGEDRKKRLKTAGYDYNKVQEKVNSIVKASQKKSIDEIAREVIAGDWGNGEDRKNRLKKAGYEYDKVQKRVNELLGK

SEQ ID NO: 2474 - protein, 315 aa, unidentified
  REGION 1..315: note = Bacteriophage sp.
MSNSPLVSYTKLSPNHSGQRTHAIDRITPHCVVGQCSVETLGNIFAPTSRQASCQYGIGVDGRVGMYVEEKNRSWCSSSNENDQRAVTIECASDTTHPYAFKDVVYNKLIELCVDICKRNGKKKLLWLGDKTKTLNYNPAADEMVLTVHRWFANKSCPGDWMYSRMGDLASKVTAKLGGSSVSNPGTAGGNVLYRVQTGAFSNKANADAMLSKVKAAGFDTYMVKVDNLYKIQVGAYSNKANADAMAAKLKAVGFDTYITTKSGTAVSSAAKKSVDELAREVIQGLWGNGQDRKNRLQAAGYDYNAVQKRVNELL

SEQ ID NO: 2475 - protein, 475 aa, unidentified
  REGION 1..475: note = Bacteriophage sp.
MALTEKQKKFIEDIARYVQKYAKTYGIKVHSAIIAQAILESGWGESRLAAQYHNYFGLKCGTKWTGKSVNMTTQEEYEPGTLTTIKDNFRVYNSMEEGVRGYFEFIQLARYQNLRGITDPRTYLQTIKNDGYATSSTYVENTMKLVTQYNLTKYDEKQEETTMGRTAQDVLNVMRGWLGYSEANGKFRQIIDLYNSVKPLPRGYAVKYSDEWCDTCVSAAGIAAGCSELIGRECGCEQHVKIFQSMGIWIEDGTITPIPGDIILYNWDDGTQPNDGYSDHIGFVESVSGGKITCIEGNKGEAVARRVLSVGAGNIRGYARPKYASGGGAAKPSKSVTEVAKEVLAGKWGNGDDRRNRLTAAGYNYNEVQAEVNRLASGGSSAPKKSVDEIAKEVIAGKWGNGDDRKNRLVAAGYDYNAVQRAVNAKLSGSAGKSVTQVAKEVIAGKWGNGEERRRKLTAAGYDYNAVQRKVNELL

SEQ ID NO: 2476 - protein, 312 aa, Listeria innocua
MKTKGIDISTWQKPSQINYDQLAKEVDFVILRAGYTGHGTGVSLHKDDAFEKHYKAFHERGIPIGVYWYSCANTKTKGIAEAKKCLEIIKGKTISYPVFIDTEDNYHQRPSGKKAITDALVGFCETVESAGYYAGIYASSSWFQDLTELDRLAPYDFWVAQWSSKEPTLRHGIWQYTSKGKLSGYSGNLDMNYAYKDYKAIIRSARLNHLGKEENAPAPTEKKSVELLAKEVIQGLWGNGEERKKRLTGAGYDYAMVQSKVNEMLSSKKSIDIIAKEVIRGDWGNGQERKNKLTKAGYDYISVQKRVNELLK

SEQ ID NO: 2477 - protein, 336 aa, unidentified
  REGION 1..336: note = Coprococcus eutactus
MASNKTPLKGYMDGIDISAWQDTIDITKVPCDFVIVKATEGTDYKNRFFAKHCDQAMKAAKLLGAFHYANGGDPHSEAEYFLAYSKKYVGKAILVLDWEGQNNPQFGRSDRAWCKEWCDYVYRKTRVKPLIYIQKSAMDNVKNLGYRLWVAQYPDYEQTGYQEHPWNEGQYDCSIRQYTSVGRLPGYEGNLDLNKSYIDKATWRKCAAIKTDSDNGKTKGKGSDSNSGKSNDKNNKNNKNRKKKSIDVIAKEVIAGRWGNGENRKKRLKTAGYDYDKVQEKVNAIVKASQKKSIDEIAREVIAGDWGNGEDRKNRLKKSGYEYDKVQKRVNELLGK

SEQ ID NO: 2478 - protein, 312 aa, unidentified
  REGION 1..312: note = Bacilli
MKTKGIDISTWQKPSQINYDHLAKEVDFVILRAGYTGHGTGVSLHKDDAFEQHYKAFHERGIPVGVYWYSCANTKAKGIAEAKKCLEIIKGKTISYPVFIDTEDNYHQRPSGKKAITDALVGFCETVESAGYYTGIYASSSWFQDLTELDRLEPYDFWVAQWSSKEPTLRHGIWQYTSKGKLSGYSGNLDMNYAYKDYKAIIRSAGLNHLGKEENIPAPTEKKSIETLAKEVIQGLWGNGEERKKRLTDAGYDYVAVQSKVNEILSSKKSIDTIAKEVIRGDWGNGQERKNKLTKAGYDYISVQKRVNELLK

SEQ ID NO: 2479 - protein, 306 aa, Gardnerella vaginalis
MSKRGIDVSEWQGDIDFNAVKASGVEFVIIRAGYGIGCKDKWFEQNYRKAKTCGLDVGAYWYSYANSGFEAAEEAQSCVNMLSGKSFEYPVYFDLEEKSQLNRGRAFCDSLITGFCNKLESCGYYAGFYTSLSTANNLVSAHVRNRYALWIAQWNTHCSYQGSYGLWQYSSSGSVPGVAGRVDMDYAYVDYPSIIKNVGLNGCKNGGSDQAARTSSIDEVAREVINGAWGNGNERKQRLTSAGYDYASVQNKVNELLGVKACRKSVDEIAREVIRGTWGNGSTRKQRLTQAGYDYDTVQKRVNELL

SEQ ID NO: 2480 - protein, 312 aa, unidentified
  REGION 1..312: note = Erysipelothrix larvae
MKTKGIDISTWQKPSQINYDQLAKEVDFVILRAGYTGHGTGVSLHKDDVFEKHYKAFHERGIPIGVYWYSCANTKTKSIAEAKKCLEIIKGKTISYPVFIDTEDNYHQRPSGKKAITDALVGFCETVEKAGYYAGIYASSSWFQDLTELDRLAPYDFWVAQWSSKEPTLRHGIWQYTSKGKLNGYSGNLDMNYAYKDYKTIIQSARLNHLGKEENIPAPTEKKSVGALAKEVIQGLWGNGEERKKRLTDAGYDYAAVQSKVNEMLSSKKSIDAIAKEVIRGDWGNGQDRKNKLTNAGYDYISVQKRVNELLK

SEQ ID NO: 2481 - protein, 312 aa, unidentified
  REGION 1..312: note = Anaerosphaera multitolerans
MRTKGIDISTWQKPSQINYDQLAKEVDFVILRAGYTGHGTGVSLHKDDAFEQYYKAFHERGIPIGVYWYSCANTKTKGIAEAKKCLEIIKGKTISYPVFIDTEDNYHQRPSGKKAITDALVGFCETVESAGYYAGIYASSSWFQDLTELDRLAPYDFWVAQWSSKEPTLRHGIWQYTSKGKLNGYSGNLDMNYAFKDYKAIIRSAGLNHLGIEENVPAPTEKKSVETLAKEVIQGLWGNGEERKKRLTDSGYDYAAVQSKVNDLLSSKKSIDTIAKEVIRGDWGNGQERKNKLTKAGYDYISVQKRVNELLK

SEQ ID NO: 2482 - protein, 312 aa, unidentified
  REGION 1..312: note = Culicoidibacter larvae
MKTKGIDISTWQKPSQINYDQLAKEVDFVILRAGYTGHGTGVSLHKDDAFEQHYKAFHERGIPIGVYWYSCANTKTKGIAEANKCLEIIKGKTISYPVFIDTEDNYHQRPSGKKAISDALVGFCETVESAGYYAGIYASSSWFQDLTELDRLEPYDFWVAQWSSKEPTLRHGIWQYTSKGKLSGYSGNLDMNYAYKDYKAIIQSAGLNHLGKEENIPAPTEKKSIETLAKEVIQGLWGNGEERKKRLTDSGYDYAAVRSKVNDLLSSKKSIDTIAKEVIRGDWGNGQERKNKLTNAGYDYVLVQKRVNELLK

SEQ ID NO: 2483 - protein, 311 aa, unidentified
  REGION 1..311: note = Ligilactobacillus ruminis
MSVKGIDVSVWQGNIDFNRIKSAGIDFVIIRAGYGNGNKDKCFEENYRGAKSAGLHVGAYWYSYASSIDGAKQEAQAFANVLSGKQLDYPVYFDIEEKSQLSLGRDFCSNIITAFCTEMEKHGYYAGFYTSLSALNSIVSDAVKNRFTLWVAQWAGKCSYSGKYGIWQFSSESNVAGINGHVDMDYSYIDFPAIIKNGGFNGYNKAPSTNAPATPKKSVDELASEVIAGKWGDGTERKNRLSAAGYDYNAVQSKVNEKLGGSAIYYTVRNGDTLSAIAKKYGTTVFAIQKLNAALIKNVNLIQVGWKIRVK

SEQ ID NO: 2484 - protein, 299 aa, Roseburia intestinalis
MDKQTFISQIAAYVIKYAAQYGIKVHSPIIAQAILESGWGQSSLAAKYHNYFGLKCGSAWTGKSVNMATSEEYTPGVHTNIRDNFRVFDSMEDGVKGYFDFINYSRYANLKGVTDPQTYVENIKADGYATSSTYVTNLMRVIRDNNLTQYDGVAQQTPSKSVDEVAQDVVNGKYGNGADRKAALEAAGYNYDEVQAKVNEILGVDTTPKKSVDEIAQEVINGAWGNGQDRKNRIEQAGYDYTAVQNKVNELCGTPKKSIDEIARAVIRGEYGNGADRKNRITAEGYDYAAVQAKVNDLM

SEQ ID NO: 2485 - protein, 312 aa, unidentified
  REGION 1..312: note = Enterococcus lemanii
MKTKGIDISTWQKPSQINYDQLAKEVDFVILRAGYTGHGTGVSLHKDDAFEQHYKAFHERGIPIGVYWYSCANTNAKGVAEAKKCLEIIKGKTISYPVFIDTEDNYHQRPSGKKAITDALVGFCATVESAGYYSGIYASSSWFQDLTELDRLEPYDFWVAQWSSKEPTLRHGIWQYTSKGKLSGYSGNLDMNYAYKDYKAIIQSAGLNHLGKEENIPAPTEKKSIETLAKEVIQGLWGNGEERKKRLTDAGYDYVAVQSKVNEMLSSKKSIDAIAKEVIRGDWGNGQDRKNKLTNAGYDYISVQKRVNELLK

SEQ ID NO: 2486 - protein, 312 aa, unidentified
  REGION 1..312: note = Exiguobacterium sp. s196
MKTKGIDISTWQKPSQINYDKLAKEVDFVILRAGYTGHGTGVSLHKDDAFEQHYKAFQERGIPIGVYWYSCANTKAKGIAEAKKCLEIIKGKTISYPVFIDTEDNYHQRPSGKKAITDALVGFCETVENAGYYAGIYASSSWFQDLTELDRLAPYDFWVAQWSSKEPTLRHGIWQYTSKGKLNGYSGNLDMNYAYKDYKAIIQSAGLNHLGKEDNAPAPTEKKSVETLAKEVIQGLWGNGEERKKRLTNAGYDYAAAQSKVNEMLSSKKSIDTIAKEVIRGDWGNGQERKNKLTKAGYDYVSVQKRVNELLK

SEQ ID NO: 2487 - protein, 311 aa, unidentified
  REGION 1..311: note = Ligilactobacillus ruminis
MSVKGIDVSVWQGNIDFNRVKSAGIDFVIIRAGYGNGNKDKCFEENYRGAKSAGLHVGAYWYSYASSIDGAKQEAQAFANVLSGKQLDYPVYFDIEEKSQLSLGRDFCSNIITAFCTEMEKHGYYAGFYTSLSALNSIVSDAVKNRFTLWVAQWAGKCSYSGKYGIWQFSSESNVAGINGHVDMDYSYIDFPAIIKNGGFNGYNKAPSTNAPATPKKSVDELASEVIAGKWGDGTERKNRLSAAGYDYNAVQSKVNEKLGGSAIYYTVRNGDTLSAIAKKYGTTVFAIQKLNAALIKNVNLIQVGWKIRVK

SEQ ID NO: 2488 - protein, 315 aa, unidentified
  REGION 1..315: note = Oscillospiraceae
MSNSPLVSYTKLSPNHSGQRTHAIDRITPHCVVGQCSVETLGNIFAPTSRQASCQYGIGVDGRVGMYVEEKNRSWCSSSNENDQRAVTIECASDTTHPYAFKDVVYNKLIELCVDICKRNGKKKLLWLGDKTKTLNYNPAADEMVLTVHRWFANKSCPGDWMYSRMGDLASKVTAKLGGSSASNPGTAGGNVLYRVQTGAFSNKANADAMLSKVKAAGFDTYMVKVDNLYKIQVGAYSNKANADAMAAKLKAAGFDTYITTKSGTAVSSTAKKSVDELAREVIQGLWGNGQDRKNRLQAAGYDYNAVQKRVNELL

SEQ ID NO: 2489 - protein, 511 aa, Streptococcus equi
MKLVESILTKNPCFTAGRKIDVKGLMLHSVGCSQPRASAFINSWNSPTFDRACVHGFIDGNDGTVYQTLPWNHRGWHCGSSINGSGNNTHIGVEMCEPACITYTGGATFKCSDVATAKAVAERTYRAAVELFAMLCKEFNLEPLADGVVISHKEGHARGIASNHGDPEHLWSQLGMGYTMDTFRKAVKEQMGGKADTKKGTQASVFAGLSEKDAIPIIGELCREDMKKSGVLASVSAAQFILESGYGKSELGQNANNMFGMKKSLSGNTWAGSTWDGTSVYTKKTQEQHTDGTYETITADFRKYPCVEDSVADHSAYLLGAKNGRSLRYKGIKGMTDYKAVAQIIKEGGYATSLTYVEKLCNIIEKWNLTQYDVTDAPAPKPSTPDSVTEFPATPFSVKVIIDDLNYRSEPSMNGKVNGQTGKGTFTIMEVKNGGWGRLKSGAGWIWLSNPTYCTVGKTVKITEDKKKSIDELAKEVIRGDWGNGTERKEKLTAAGYDYASIQKRVNEILK

SEQ ID NO: 2490 - protein, 312 aa, unidentified
  REGION 1..312: note = Enterococcus lactis
MKTKGIDISTWQKPNQINYDQLAKEVDFVILRAGYTGHGTGVSLHKDDAFEQHYKAFHERGIPIGVYWYSCANTKAKGIAEAKKCLEIIKGKTISYPVFIDTEDNYHQRPSGKKAITDALVGFCETVEIAGYYAGIYASSSWFQDLTELDRLAPYDFWVAQWSNKEPTLRHGIWQYTSKGKLSGYSGNLDMNYAYKDYKTIIQRAGLNHLAKKESTPAPTEKKSVETLAKEVIQGLWGNGEDRKKRLTDAGYDYAVVQSKVNEILSSKKSIDTIAKEVIRGDWGNGQERKNKLTKAGYDYISVQKRVNELLK

SEQ ID NO: 2491 - protein, 312 aa, Listeria innocua
MKTKGIDISTWQKPSQINYDQLAKEVDFVILRAGYTGHGTGVSLHKDDAFEKHYKAFHERGIPIGVYWYSCANTNAKGVAEAKKCLEIINGKTISYPVFIDTEDNYHQRPSGKKAITDALVGFCETVENAGYYAGIYASSSWFQELTELDRLAPYDFWVAQWSSKEPTLRHGIWQYTSKGKLNGYSGKLDMNYAYKDYKTIIQRAGLNHLGKEENAPAPTEKKSVETLAKEVIQGLWGNGEERKKRLTDAGYDYAAVQSKVNEMLSSKKSIDTIAKEVIRGDWGNGQERKNKLTKAGYDYVSVQKRVNELLK

SEQ ID NO: 2492 - protein, 306 aa, Gardnerella vaginalis
MSKKGIDVSVWQGDIDFNAVKASGVEFVIIRAGYGIGHKDKWFEENYRKAKTAGLDVGAYWYSYASSAGEASLEAQSCVNILSGKSFEYPIYFDLEEKSQLNRGRAFCDSLITSFCNKLETYGYYAGFYTSLSVANNLVSSHVRNRYALWIAQWNTHCDYQGSYGLWQYSSSGSVDGISGRVDMDYAYVDYPSVIKNAGLNGYKNGGSYTVPQTSSIDEVAREVINGDWGNGNERKNRLTSAGYDYTSVQNKVNELLGVKAYRKSVDEIAREVIRGTWGNGSMRKQRLTQAGYDYNAVQKRVNELL

SEQ ID NO: 2493 - protein, 242 aa, unidentified
  REGION 1..242: note = uncultured Ruminococcus sp.
MAYTNSKMVSYTKLSPNHSGKRTHSIDRITPHCVVGQCSVETLGNIFAPKSRQASCNYGIGPDGRVGMYVEEKNRSWCSSSNANDQRAVTIECASDTKHPYAMNDKVYASLIKLCTDICKRNGKKKLLWLGSKSKTLNYKPKSDEMVLTVHRWFANKSCPGDWLYSRLGDLAKKVTANLSGTSSVKKDTPGEKKNSGTKSVDHVAREVIQGKWGNGTDRKKRLTAAGYNYNAVQKRVNELLK

SEQ ID NO: 2494 - protein, 285 aa, unidentified
  REGION 1..285: note = uncultured Ruminococcus sp.
MSYTNSKLVSYTKISPNRNINRNHKIDTVSIHCVVGQCSVETLGSIFASASKEASSNYGIGYDGRIGMYVEEKDRSWCTSSASNDNRAITIEVASDTYHPYRVNDVAYKSLIKLLVDICKRNGIKRLVWSTNKSERMNHLNGCNMTVHRDYANKSCPGDYLYNLHGQIAKEVNAQLGLGSSKPVTSKKTLYRVRKSWKDAKSQKGAFYDLSNAKKCADKNNGCSVFDESGKVVYTPKSSGKKSVDAIAKEVIQGKWGNGTDRKNRLTKAGYDYNAVQKRVNEILS

SEQ ID NO: 2495 - protein, 302 aa, Ruminococcus sp.
MAILKPDKTTNLGGVTVNEYLLTNHNPNHIDMPSVSMEGKIIGVTVHNTDWISTVAGTTPAEQYTRATVNGNMKDVRVHYYCDDTCAWQNLPLTLSGWHAADGSGNGNRRTIAIECIMSSAYNDKDKKSEDNCARLVAALLKKYNLDINHLYTHTHWLNVRDGKSGTVDYLNTAKNSYKNCPAYILPHWAEFKKKVQSYMNSGSSATPTSKQLYRVRKTWSDAKSQIGAFSFLENAKRACKAGYAVFDSNGKQVYPAKKSIDEIAREVIQGKWGNGAERKKKLTDAGYDYNAVQNRVNEILR

SEQ ID NO: 2496 - protein, 301 aa, unidentified
  REGION 1..301: note = uncultured Ruminococcus sp.
MAILKPDKTTTLGGVTVNEYLLTNHNPNHIDMPSVSMEGKIIGITVHNTDWITTAAGTTPAEQYTRATVNGNMNDVRVHYYVDNTCAWQNLPLTLSGWHAADGSGNGNRRTIAIECIMSSAYNDKDKKSEDNCARLAAALLKKYNLDINHLYTHTHWLNVRDGKSGTVDYLNTAKNPYKTCPLYILPHWAEFKKKVQSYMNSGSSAPATTQLYRVRKTWADAKSQIGAYASLENAKRACKDGYSVCDWNGNIVYPSKKSIDEIAREVIQGKWGNGAERKQKLTAAGYDYNAVQKRVNELLG

SEQ ID NO: 2497 - protein, 285 aa, Ruminococcus bromii
MSYTNSKLVSYTKISPNRNINRNHKIDTVSIHCVVGQCSVETLGSIFASRGKEASSNYGIGYDGRIGMYVEEKDRSWCTSSASNDNRAITIEVASDTYHPYRVNDVAYKSLIKLLVDICKRNGIKRLVWSTNKSERMNHLNGCNMTVHRDYANKSCPGDYLYNLHGQIAKEVNAQLDLGSSKPVTSKKTLYRVRKSWKDAKSQKGAFYDLSNAKKCADKNNGYSVFDESGKVVYTPKSSGKKSVDAIAKEVIQGKWGNGADRKNRLTKAGYDYNAVQKRVNEILS

SEQ ID NO: 2498 - protein, 285 aa, Ruminococcus bromii
MSYTNSKLVSYTKISPNRNINRNHKIDTVSIHCVVGQCSVETLGSIFASASKEASSNYGIGYDGRIGMYVEEKDRSWCTSSASNDNRAITIEVASDTYHPYRVNDAAYKSLIKLLVDICKRNGIKRLVWSTNKSERMNHLNGCNMTVHRDYANKSCPGDYLYNLHGQIAKEVNAQLGLGSSKPVTSKKTLYRVRKSWKDAKSQKGAFYDLSNAKKCANKNSGYSVFDENGKTVYTPKSSGKKSVDAIAREVIQGKWGNGADRKNRLTKAGYDYNAVQKRVNEILS

SEQ ID NO: 2499 - protein, 307 aa, Sharpea azabuensis
MNGIDISVHQSGLDLKKVKSAGYDFVIIRCGYTGYGAKRGKNKDSLFDYFYQKAKENGLKVGAYYFSCADSMSFGISEAEFVLNIIKGKEFDLPIYIDVENPTWQGHNKKGVTDAIIGFCEKIESAGYRSGVYASSFWFDKMIDTSRLNAISKWVASWRSTKPSFNWSHFDMWQCSGDFGNRVTISEMVVDTNVWYGDEEPTKPTKPTKPSKKKSIDEIAKEVIDGKWGNGSERKKKLTDAGYNYDSVQKKVNELLKVSKTTYAVKKGDTLSAIAKKFNTTVAKLKKLNDIKDVNKIYVGQVLKIGG

SEQ ID NO: 2500 - protein, 41 aa, unidentified
  REGION 1..41: note = Neofamilia massiliensis
MDELAREVIRGDWGNGEERKKRPTNAGYDYHAVQRRLNQLL

SEQ ID NO: 2501 - protein, 135 aa, Bifidobacterium longum
MDLSYVDYPATITGGGFNGYTKGTTTGSTPSATPAKKSVDEIASEVIAGKWGNGDDRRNRLTAAGYDYNAVQAKVNEKLGAAAKTTAVYHTVKRGDTLSAIASKYGTSVSAIQKLNSSLIKNVNLIQIGWKIRVK

SEQ ID NO: 2502 - protein, 254 aa, Bifidobacterium longum
MRERHRRESGRRKVLIQLLKGKQLEYPVFMDNEAQPASAKAGITEATIAFCETMETAGYFVGIYGSTDSGFRERMDDSKLTAYTHWVAQYSSKCTYAGSYGIWQYSSTGRVSGISGNVDMDLSYVDYPATITGGGFNGYTKGTTTGSTPSATPAKKSVDEIASEVIAGKWGNGDDRRNRLTAAGYDYNAVQAKVNEKLGAAAKTTAVYHTVKRGDTLSAIASKYGTSVSAIQKLNSSLIKNVNLIQIGWKIRVK

SEQ ID NO: 2503 - protein, 420 aa, unidentified
  REGION 1..420: note = Mediterraneibacter gnavus
MKKEEFIQKIAGYVKKYAAAYEIKVCSPIIAQAILESGWGESRLAKDYHNYFGLKCGTKWQGKSVNLATWEEYEAGTAMVISDYFRVFDNMEEGVKGYFELLQLPRYQNLKGITEPGQYLETIWADGYATSSVYVQKNMELIEQYQLMKYDENASGRSAQDVLNVMRSWIGYSEANGKFRQIIDLYNSYLPLARGYAVQYTDEWCDTAVSAAAIQAGCVDLIGTECGCEKHIEIFKEKGIWIEDGTIVPLPGDIILYNWDCQAQPNDGYSDHIGYVESVSGQMITVMEGNYNEAVARRQIPVGWGQIRGYARPKYTEGVTGRPSKSIEEVAGEVIQGKYGNGEERRKKLCDMGYDPDAVQREVNRQLSQNEAPAEYYVVQENDTLSEIAKRFATTYLELAAWNGIADPNMIYIGQKIRIR

SEQ ID NO: 2504 - protein, 284 aa, unidentified
  REGION 1..284: note = Eubacterium sp. CAG:786
MKIKGVDLSYCQEGISFPALKQAGVKFAIIRAGFSTKKDVTMDRFVADCKKYGIAYGFYWYSYAMSIKQAQAEAEKCVEVIKGLSPTYPVFFDMEEKKQIDGLNTDTRTKMAIEFCERIIKAGFKPGIYANPPFMENYYDRSKIVGKYDIWLAHWTNSPERPSRYNYGQTMWQWGVDRIGGYDVDGDICFKGYSNKTVDELADEVLAGKWDNGAERERLLTAAGYDYNVVQKRVNEKLYKKTVDEIAVEVIVGLWGNGAERKERLTNAGYDYSEVQERVNQIIK

SEQ ID NO: 2505 - protein, 53 aa, unidentified
  REGION 1..53: note = Caudoviricetes sp.
MYTLKSSGKKSVDAIAKEVIQGKWGNGADRKNRLTKAGYNYNTVQKRVNEILS

SEQ ID NO: 2506 - protein, 203 aa, unidentified
  REGION 1..203: note = Caudoviricetes sp.
MEKSVADHSAYLLGAKNGENLRYAGLKGCTDYKKAAQLIKDGGYATSLTYVEKLCSIIEKWNLTQFDGKAADALAKNPDTVTTFPTVPFLVKVIIDDLNYRSEPSMNGKVNGQTGMGTFTIVEVRDGWGKLKSGAGWIWLCNPSYCTVGGKVTSAPTPSKSIDELAREVIQGKWGNGEERKQKLKAAGYDYSVVQSRVNELLK

SEQ ID NO: 2507 - protein, 289 aa, unidentified
  REGION 1..289: note = Caudoviricetes sp.
MKIKGVDLSYCQEGISFPALKQAGVRFAIIRAGFSTKKDVTMDKFVADCKKYGIDYGFYWYSYAMSVEQALTEAEKCIEVIKTLSPTYPVFFDMEEKKQISGLNTDTRTKMAIAFCEKIRQAGFKPGVYVNPSFMENYYDKSRIVGKYDIWLAHWTNSPDCPSKNNYGQTMWQWGLDRISGYDVDGDICFTDYGKKNPVKKTIDQLADEVLEGKWDNGAERYRLLTAAGYDYNTIQKRVNEKLYRKTTDEIAVEVIAGLWGNGAERKEKLTEAGYDYSEVQKRVNEMLR

SEQ ID NO: 2508 - protein, 185 aa, unidentified
  REGION 1..185: note = Candidatus Ventrenecus stercoripullorum
MLVKKGQEVDENTQLGIIGDSGNAYGRHLHFEVATGYSSTTRIDPTPYLTKAIYEEPVQPTEPDKSIDELANEVIAGKWGNGQERKDKLTRAGYDYNAVQSKVNELLSSSQPVEEFKVGDKVAVTGYATADSFGKGSRTAEYSGDILYITKITNLTAPRPYHISKGNTFGNSNRGWVAKSQIKKA

SEQ ID NO: 2509 - protein, 63 aa, unidentified
  REGION 1..63: note = Clostridia bacterium
VYSAVQNRVNELMSGSMQTKSVETLAREVIQGKWGNGEERRQKLTAAGYNYSAVQSRVNELMK

SEQ ID NO: 2510 - protein, 165 aa, unidentified
  REGION 1..165: note = Gemella sp. zg-1178
TIELCVDICSRNGINKLEYTGDTTGNLTKHEWFAPTNCPGPYLGSKFPYIAAEVNKRLSGQASTPVPPTDTNLDDVARQVINGQFGNGDARKTALISAGYDYHQVQAKVNELVSGNVTSSLKYIDDIAQEVINGHWGNGQERKHRLTQAGYDYDKVQQKVNEILS

SEQ ID NO: 2511 - protein, 215 aa, unidentified
  REGION 1..215: note = Lachnospiraceae bacterium
MGSVVGQYGSVIKFEVSPRKVLTFSDMERTQEGRWKDHEIPGVVPQSEFVGPAATTMSLKIKLKAQLGVKPRATIASLERCARNGTVDTLVIGGSKYGWGSAKWIVKSVTDKWERFIGGGLMEAGCTVEFKEYAESSKAVTVIKKPSPAPKKTTAAKTAAASKPSYNVDDIARRVIRGEFGNGQARFNKLSVQGYNWKAVQNRVNEMLGCRKRYT

SEQ ID NO: 2512 - protein, 335 aa, unidentified
  REGION 1..335: note = Candidatus Cloacimonadota bacterium
MAYTNSPLVSYTKLSPNHSGQRTHSIDRITPHCVVGQCSIETLGNIMYPTSRQASCNYGIGPDGRVGMYVEEKNRSWCSSSNANDQRAITIECASDTFHPYAMNDKVYATLITLCTDICRRNGKKKLLWFADKNKSLNYIPAADEMVLTVHRWFANKSCPGDWLYSRLGDVAAKVTANLSSTASTTTPSTSKTTEEVAKEVIAGKWGNGEDRKQRLTAAGYNYSLIQAKVNELMGAKTTVSSKSIDELAREVIQGKWGNGEERKNRLISAGYDYSAVQAKVNELMGGIKSTKSVDQLAREVIYGYWGNGQDRKNRLTAAGYDYSAVQNRVNELLK

SEQ ID NO: 2513 - protein, 520 aa, Ruminococcus sp.
MEMKGIDVSGYQGVIDFNKVKASGKQFVIIKAGYSTSTVDTFETNYKNAKTAGLHVGAYWYSYAETLADGKAEAQAFIKAVKGKQFDFPLYMDLEESSQFKKGKKFCSDLVTTFCSELENAGLFAGLYCSTSPLETYITEDVRKKYVIWCADYRGKCYYKGDYGIWQSGTGKVNGIDGDCDIDTGYVDYSTIIINGGFNGYPKKTTVNTANTNTTNTSTTAKKVKFTPRTTAPSATDKHWISTTKGGLNICIVISGGSVLPNCVGYAWGRFYEIIGEKPTLASINAENWYPNTADGYKRSDTPKVGAIACWRKGQVYNGNDGCGHVAIVERVEANGDIFTSNSAYGGTRFYTQTYKKSNGYNSGSLVFQGFILPPVELEVDNTTTAATSTTASGASTNTTNTNTASNTTLKVGDIVDFTGDTHYGSSTAVNGTKCTAGKAKITIIAKGAKHPYHLVNCGNGSSVYGWVNAEDIKTLKTVDEIALEVIRGDWGNGDERKKRLTEAGYNYSDVQKIVEKLMK

SEQ ID NO: 2514 - protein, 362 aa, Clostridium sp.
MEKFGIDVSEFQGAVDWQKAKTSGVTFAILRCGFGENVESQDDKRFAANAEACEALNIPYGVYLYSYSTNVEHAKSEAEHVIRLVKGKKLTYPVFYDMEDNDTLGSCTTSVMGDIAEAFCNEILKAGYQVGIYANLYWLNNKLTDSRFDKWDKWVAQYYKECQYEKPYVGWQYSSTGRVDGVTGNCDMNFFYKEYAGGENPKKTINELADEVIAGKWGINKDRKDRLTAAGYDYDAVQARVNQLLSKKKTIEELADEVIAGKWGIDKDRKDRLTAAGYDYDAVQARVNERLGANSFQRYNVKITTAVLNVRSGAGTNYSVTGSVRMNEVYTIVAEASGTGASKWGKLISGAGWISLDYARKI

SEQ ID NO: 2515 - protein, 87 aa, unidentified
  REGION 1..87: note = Lachnospiraceae bacterium
MRACDLIRQDGWATSLKYSENLKSLIQKHGLASWDAGSRPEEPAGLDAIAREVIDGKWGNGQERKQRLRDAGYDPAEVQRKVNEILR

SEQ ID NO: 2516 - protein, 288 aa, unidentified
  REGION 1..288: note = Bacteroidales bacterium
MAYTNSSMVAYTRLSPNHSGQRTHSIDRITPHCVVGQLSAESICGCFISPSRQASCNYGIGTDGKVSLCVEEKNRSWCSSSNANDQRAVTIECASDKTEPYAMNSKVYDSLIKLCTDICKRNGKRKLLWLGDRNKTLNYTPKSDEMVLTVHRWFANKSCPGGWLYARLGDLAAKVTAALGTGASADKAASQLYRVRKSWADSKSQKGAFSVLANAKQCADSNKGYSVFDGNGKKVYPADAPDTKKSVDAIAHEVIRGDWGNGYERKQKLNAAGYDYSAVQKKVNELLR

SEQ ID NO: 2517 - protein, 478 aa, unidentified
  REGION 1..478: note = Clostridiales bacterium
MKLVESILTRNPCYTVGRKITVKGLMLHSVGCPQPMASAFISSWDSPAHDTSCVHGFIDGNDGTVYQTLPWNHRGWHCGSGSKGSGNNTHIGIEMCEPACIKYTAGSNFICSNLAEARALAKRTYKAAVELFAMLCKKYSLDPLADGVIISHREGQSRGIASNHGDPEHLWAQLGMGYTMDGFRKAVKAAMGGASSGTDGHTKIMGDAVATAEQMKAYIKAKNPKVPQSVLDMVPLYLSEGRAEGVRGDIAFAQSCLETGNFTFSGSAVTLSQNNFCGMGVTSNGVKGNSFGTPQFGIRAQVQHLKAYASTDALKNACIDPRFKYVTRGCAEYVEWLGQKENPDGKGWAAGAGYGEKILSILKGILGTAGGAVPSAPAEAEIWYRVRKSWADASLQKGAFKSLENAKKCADDNPGHSVFDGNGSKIYPADPSAKKSVDAIAHEVIQGKWGNGAERKQRLTAVGYDYSTVQKRVNELLK

SEQ ID NO: 2518 - protein, 107 aa, Lactococcus raffinolactis
MLSFSIILPYLIVDLKLCNRTTLAKEVIQGLWGNGEERKKRLTDAGYDYVAVQSKVNEMLSSKKSIDAIAKEVIRGDWGNGQDRKNKLTNAGYDYISVQKRVNELLK

SEQ ID NO: 2519 - protein, 424 aa, unidentified
  REGION 1..424: note = Clostridium sp. AF27-5AA
MTKNEFISRVAGYVQKYAAAYGILVHSPVIAQAVLESGWGGSRLSSQYHNYFGLKCGSRWTGKSVNMKTQEEYTPGTLTTISDNFRVYDSMEEGIKGYFEFIQLPRYRNLKGITDPEKYLETIRADGYATSSSYVENCMKLIRQYDLTKYDEGEKKTMGKTAESVLNVMRGWLGFNEFNGRFKEIIDLYNSVKPLPRGYAVKYSDEWCDTCVSAAAVKAGCEELIGRECGVEKHIEIFKQKGIWIEDGTITPKPGYVIAYNWDKSTQPNDGNADHIGYVESVSGSNITVIEGNKGEAVARRVIPVGWGYIRGYAAPKYDAATVTPVPSTAEKSVEEVAKEVMAGKWGNGEERKNRLKAAGYDYAAVQAKVNQLAKGTSNQKSIDAVAREVIQGKWGNGADRKKRITSAGYDYSAVQKRVNELLK

SEQ ID NO: 2520 - protein, 327 aa, unidentified
  REGION 1..327: note = Granulicatella sp. zg-ZJ
MSNSPLVNYVKLSPNHSGQRNHTIDTITIHHMAGNLSVETCGNVFAPTSRQASSNYGVDSSGRVGMYVEEHNRSWCSSSATNDNRAITIEVANDEYGGNWHVSDVALEKTIQLCVDICQRNSIPSLNYTGDTSGNLTKHEWFANTNCPGPYLGSKFPYIASEVNRRLNGGQSSPSVPPTDTNLDDVARQVINGQFGNGNTRIQRLRAAGYDPVHVQERVNALLGKGTVTKPTLKSVDEVAREVLNGKWGNGDARKSALANAGYDYNQVQTKVNELVSGNVTPSLKPIDVIAREVINGHWGNGQERKNRLSQAGYDYDQVQQKVNELL

SEQ ID NO: 2521 - protein, 327 aa, unidentified
  REGION 1..327: note = Gemella sp. zg-570
MSNSPLVNYINLSPNHSGLRNHKIDTITIHHMAGNLSVETCSNIFASPSRQASSNYGVDSNGRVGMYVEEKNRSWCSSSAANDNRAITIEVANDEYGGIWHVSDIALEKTIELCVDICSRNGINKLEYTGDTTGNLTKHEWFANTNCPGPYLGSKFPYIAAEVNKRLSGQLSTPVQQTDTNLDDVARQVINGQFGNGNDRIQRLRAAGYDPFHVQERVNVLLGKGTVAKPILKSVDEVAREVLNGKWGNGDARKSALANAGYDYNQVQVKVNELVSGNVTPSLKPIDVVAREVINGHWGNGQERKHRLTQAGYDYDHVQQKVNEILS

SEQ ID NO: 2522 - protein, 284 aa, Ruminococcus sp.
MSYTNSKLISYIKISPNRNINRNHKIDTVSIHCVVGQCSVETLGSIFASASKEASSNYGIGYDGRIGMYVEEKDRSWCTSSASNDNRAITIEVASDTYHPYRVNDAAYKSLIKLLVDICKRNGIKRLVWSTNKSERMNHLNGCNMTVYRDYANKSCPGDYLYNLHGQIAKEVNAQLGLGSSKPATSKKTLYRVRKSWKDAKSQKGAFYDLSNAKKCADKNSGYSVFDESGKSVYTPKSSGKKSVDAIAREVIQGKWGNGADRKNRLTKAGYNYNTVQKRVNEIL

SEQ ID NO: 2523 - protein, 317 aa, unidentified
  REGION 1..317: note = uncultured Granulicatella sp.
MVEKLIEPLLTDSGKLVSIDFVVIHNDAGRMNPKEYIDWLKGRDKSLGIAHYYCNRRVIAQVLNTTDIGYHTGDWWSNCRSIGYEVCESLKVSDENFLANEDVALAQATEDLLFYGLPINADTVRLHHEFVPTTCPHRSMELHGGTTESVKAYFVERMQYFATLGDKAWIILFKLGNHGQKFEQERIISRNEDTLTHICRLVIEGKFGNGEERVKQLTEAGYDAVGIQKEVNRILAEESGELNSEKQEELFGNQEDNENRTGAGVPGNVLYTKDFLDTIAAEVIQGDWGNGEERRDRLVQAGYDYDVVQQRVNELMG

SEQ ID NO: 2524 - protein, 225 aa, unidentified
  REGION 1..225: note = Caudoviricetes sp.
MRRFVSVVAAVVLLCGVGACGPTQSDEPAAPSPSASETAKPRKVAKPHVAERQSQPVEVEEPQPTEPDYEALAQRVVAGEFGNGEARREALGADYERVQGIVDGMMAVQSAPVQSAAPVQSVQQSAPTSVEPSQVETSEVAQPVEPADTPNDVVAEFSADPSQSWDDWRTEFGSDADVDVPLSQIPVCAALDGSTGTGYEKVCQATSSDGLHYVLVGGTAMEVWR

SEQ ID NO: 2525 - protein, 274 aa, unidentified
  REGION 1..274: note = Caudoviricetes sp.
MFQIRTSKPSAGNKFYITTSRGGYSSCIEGYPTDKDCNVLSNCVGYACGRFNEIIGSMRYPYLNCNAENFIERAINTYGLEIGQTPKAGAIMVWQKGSTLSGNDGAGHVAIVEKVIDANTIYTSESGYGSNAFWNSTRKNNNGRWGIGSGYTFRGFIYNPSVKEETPQPTPKKDIDTMASEVIQGLWGNGEERKQRLTNAGYNYSEIQNRVNEILSPSKPSVDILDLVKKTIRGDFGNGDARKQALGNNYSEVQRQVNLNYQNGTTNWNNIKLY

SEQ ID NO: 2526 - protein, 375 aa, Eubacterium sp.
MAKRGIDISAHQGNIDLNVLKNQIDFVIIRVGYGTKGTLDTKFKRNVDLCKQLGIPYGFYWYSYALDVAGASSEAKHFLSAIAPYEPTYGCWFDMEDADGYKKRNGMPSNSVLQDMCYEFCQTVEKAGYYTGIYASLSWFNNQLAGDKLSKFDKWIAQWPTSGGKQKGLSVDPNSRTGWSLWQFTSDGKFSGYSGKLDTNYAYKTFPNPNKSNSDVMPIPDPTPATPQGSTLELALGVIQGKYGDGDKRKELLGTRYAEVQDFVNHIYSASTDTLAQEVLNGKYGDGETRKAILGSRYDDVQAKVNALCSAPATPSLKKWDQVKFIGTKSYSGIKLADWVHNGIFTVIQVSGDRVVIGKGMSVTAAVNIRDCQKV

SEQ ID NO: 2527 - protein, 341 aa, unidentified
  REGION 1..341: note = Bacteriophage sp.
MSSILPTIIDVSEWQGDIDWDIVKPNIHFAILRVQDGDHADTKLSRNVAACQRLGIPYYAYGFYRNGGAVEAERMINRLVYAGGSNCRGYILDVEVEGQSHDSIKAAMSKLNETGLDNGIYIAAHLFNEYGGDTYGEKWRWIPTYGPNDGYAHRAPGKQCDLWQFTSNGRVPGISGGVDCNACLGRSLNDFISGTVTPNEVKPATGVSGNVYDIAADVISGKYGSGDARKSALGSRYDEVQSAVNFVLKSDASVLALEVMKGTFGDGDTRKRRLGSRYNEVQKVVDEKYSAKKVRCYIVQSGDTLSGIAKKLGYGNDYMTLARNNGISNPNVIRVGQKIYY

SEQ ID NO: 2528 - protein, 225 aa, unidentified
  REGION 1..225: note = Lactococcus carnosus
MKKITCMATLALTLLGTAGVATSAHADELSDKAQQVIKGDFGNGQDRKEKLGQDYDRVQSKVNELLGLASVPNEASLEDDKAPTDSSATSEVSVSQSSFSTASVTAQTQYSHTENGHVQGGYYAISSSTPNITISASGKTVAGTVSRGGIGLEKGTIILAYVLNFDANDVYTSGSVTSSGYVDASITLAVGQKYAGQTINFLSTSGGRAGSGSYIYPITANLNLN

SEQ ID NO: 2529 - protein, 225 aa, unidentified
  REGION 1..225: note = Lactococcus carnosus
MKKITCMATLALTLLGTAGVATSAHADELSDKAQQVIKGDFGNGQDRKEKLGQDYDRVQSKVNELLGLASVPNEASLEDDKAPTDSPATSEVSVSQSSFSTASVTAQTQYSHTENGHVQGGYYAISSSTPNITISASGKTVAGTVSRGGIGLEKGTIILAYVLNFDANDVYTSGSVTSSGYVDASITLAVGQKYAGQTINFLSTSGGRAGSGSYIYPITANLNLN

SEQ ID NO: 2530 - protein, 325 aa, unidentified
  REGION 1..325: note = Clostridiales bacterium
MKYGIDVSRWQKGFDLKKAWNEGFSYVIIKAGGADTSSKTPYKDSQFDAFYTQARAGAWKIGAYFFGNAFSKADAIKEANAFISYLQGKAITHVYYDVEGAMLNQGFTHLTEIIQTFCQTMINAGYACGIYTSESHFNSRFNDNAVAIYPHWVARYSSKPPKLKSIAPIEIWQYGGSVNYIRDPKIAGTTVDQDQINIEWTDQVGLPKQEVIVPVETEKTVDQLANEVLAGLYGNGIQRKMNLGSRYAEVQKRVDEIVAQRKETGKPYVVTEKDTQKTILGITVKRNDTLSQIAKRYGTTVDALVKANNIKDKNKIYVGQYIVIA

SEQ ID NO: 2531 - protein, 208 aa, unidentified
  REGION 1..208: note = Mediterranea sp.
MAKFNLSKGEEKKSNFNLSKNEEPKESKFNLSKEAAPAASNKDSNTDGKKRKWWLWLLLLIVVIIAVILCVRNCSPAGDNQGANEGTTVEQTAATPTEEAQSAEPKAAEESRDKAPVSEETVTPAPTEPATTPQAEAKPANQPATTPAEKPAAAPVRANTSTLPQGTVEEMAKRVIRGEFGNGAERRQALGGEYNIIQAKVNEIYSRR

SEQ ID NO: 2532 - protein, 343 aa, unidentified
  REGION 1..343: note = Senegalia massiliensis
MKIKQQLIRDTKHKYGKSNKKKYITVHQTDNWDRGANAQVHANLQSRVNPRKASWHWQVDDIQAIQSFLHYFQLWHCSDGRGNGNLNSIGVELCLNRDGNYNKAVENGAELVAYIMKKENIQLSNVVQHNYWSGKNCPSQIRRGKNGISWSDFKKLVAKKLNKDIVEPTKTIEKLIAETLAGKYGNGAERRRLLGSNYNEVQREIDKMYNSKPIPKPTKTIDKLVEETLLGFHGNGAERKKSLGSNYQKVQQIINGKFERVDINKLVKETLAGKHGNGAQRKKSLGKYYNEVQNIINKKYSGKSIDTLVKETLEGKHGNGAERRKSLGTHYKEVQNIINKIYK

SEQ ID NO: 2533 - protein, 301 aa, unidentified
  REGION 1..301: note = Senegalia massiliensis
MKIKQQLIRDTKHKYGKSNKKKYITVHQTDNWDRGANAQVHANLQSRVNPRKASWHWQVDDIQAIQSFIHDFQLWHCSDGRGNGNLNSIGVELCLNRDGNYNKAVENGAELVAYIMKKENIQLSNVVQHNYWSGKNCPSQIRRGKNGISWSDFKKLVAKKLNKGIVEPTKTIEKLIAETLAGKYGNGAERRRLLGSNYNEVQREIDKMYNSKPTTKPTKTIDKLVEETLLGFHGNGAERKKSLGSNYQKVQQIINGKFERVDINKLVQETLAGKHGNGAQRKKSLGKYYKEVQNIINKRYK

SEQ ID NO: 2534 - protein, 126 aa, unidentified
  REGION 1..126: note = Senegalia massiliensis
MKKENIQLSNLVQHNYWSGKNCPSQIRRGKNGISWSDFKKLVAKKLNKGIVEPTKTIEKLIAETLAGKYGNGAERRRLLGSNYNEVQREIDKMYNFKPIPKLTKTIDKLVEETLLGFHGNGAERNH

SEQ ID NO: 2535 - protein, 187 aa, unidentified
  REGION 1..187: note = Bacteroidaceae
MSNQEVKLKRKVQLREKVEEPSIIPTPPDNGNTPKSKKWIWAVAAIIVVGLIGYWALFKSDKVTEENRLTEVVEEGIAEQPTTTSELKKDDIADENPVETDTTASSENIPDSQAETKQIPVADSNKSGTNETSAILTDTHVSNDVEAEAMKVIRGDYGVGQERKNKLGVKYQTIQKRVNELKREGVF

SEQ ID NO: 2536 - protein, 537 aa, unidentified
  REGION 1..537: note = Bifidobacterium sp. ESL0728
MSKHTPQHALRAPRTRSRAGLLTTTGLAAIALSVMAPSANAAVLNNDGSVTVQPGDTLSQIATDYGTKDGSWGYWKGFTSGDDDLIYPGEFVGDSRKMDTSGLEAKSRAALKKGAVPTASVTTDDVDQLAHEVMLGKYGNGEARKQALGDKYDAVQAKVNQLMGYGVVAAANATNGVNAPASNAASRPMTHPSQAYGPVPSAPAPAIPAPAPAAPAPAAPIASTPSTPSTPAPAPSAPSQPSTPSQPSQPSQPSTPSTPSHPSTPSQPSQPSTPSHPSTPSHPSVTPHDIVHPEGSEGTYDHKPSPAWTEHIRVDENGNMVDDVSERPYWVAGTPATPGTPATTHVVHHPAVPGSSVNENGTPVWGDWGTAGYAEAITVHIYTSKFDGFQARDWSGTDQVNGTDYHHVAGAADQVDFHNQGLPDSVLEAHPEWTTTPDAGMTVTNVAWHQWIATPDNVGKRKIAYFTYSDGFHTPVANPNVYYNPATGIDTAGETWHDVEGYPTHVVNKPGTAAYDTTETIPGTPGTPGIPGTWKTR

SEQ ID NO: 2537 - protein, 206 aa, unidentified
  REGION 1..206: note = Porphyromonadaceae bacterium
MSNKKLFSPEDFDKDKTLFRPEDFDKEPREPKPSPDSTTAAPTAAGTPEPTGDDLPPKKSKGWIWWVAAAVVVVAGGVWYFAARDNGDASQQEQTAVVAAAEPASDSSAEEAAMQESGEVAPGTTPQTADADAGQPAAAEPAVPATAPENDKPAAAKAAPTGDIEDTAMSVIRGNYGNGNARKLNLGDKYQTIQNRVNQLKREGAF

SEQ ID NO: 2538 - protein, 211 aa, Caryophanon sp.
MTNNEFIEQIGKCVKKYAYVYGIEVHSPIIAQAILESGWGKSGLASKYHNYFGLKCGSSWKGKSVNMATKEEYKVGTLTNIRDNFRVYDSMDAGIKGYFDFINTSRYANLKGVKSPEEYVRRIKADGYATSSKYVDNIMRVIRDNKLTRFDDKVGGNMKKEELTGKVLSGKEIINILAKRVINGDYGTGVDRKEKLGELYPIVQKRVNELC

SEQ ID NO: 2539 - protein, 180 aa, Prevotella sp.
MANERKKIFSPEDFDKEPKRKPWYKKPWPWVILALILVAIIIVCVFKGCNTNSKDSSNEAVVSDTIQNSVVDDSAATNKDEGAPVNGEENANEEYPETSSNNGEEPVRSDENVVPTQATINTSKQVGNTLSESVSNDVEAEAMKVIRGDYGDGQVRKDNLGSKYQTIQNRVNELKRAGVF

SEQ ID NO: 2540 - protein, 202 aa, unidentified
  REGION 1..202: note = Muribaculaceae bacterium
MADSDVKLKHKVQLRKKIEETEPVSEPLPVDPQPEKPRRNSKMWLWIFSLIVIGLLVWWIIATIRTEDKTVEDENPAPTVEEVIEQPENVEQGTEVPAVSEEQLSEETTPTDVQETEPLTPTPSTTKEEPSVPVQSQPSKSSPATTQTQSNASLNVSNDVEAEAMKVIRGDYGIGQERKDKLGNKYQTIQNRVNELKKEGVF

SEQ ID NO: 2541 - protein, 168 aa, unidentified
  REGION 1..168: note = Muribaculum sp.
MSTNNKKLFSPEDFDKEPSEKKSWWKGKKKWVIPVGAVICVIAIVGIISSKSDKYEISETEQSVAVEETSITIDSAKNKQSSENEVVSMEETPSEQISNETAPTATVQSEQNVEASAIPSSNINDVEAEAIKVIRGDYGVGQERKDKLGDRYQPIQNRVNELKREGVF

SEQ ID NO: 2542 - protein, 215 aa, unidentified
  REGION 1..215: note = Bacteroidales bacterium
MAETQIRKKVQIKEKSTPKKSKWWLWLLLAIIAIAAVVLCVKNCSSNDAEKAVTEKVEQATAKAAEIAADVQNPNVNFEEAQAKVAEAQQAVDEAKAQATTEEEKQAVAEAQAKVDEAAQAVEAAKTPATATPENEDAVTSAASEQSAAVPAEPAQTTQQTQQPSATKVSGDVEQLAKEVWAGTYGNGAERKQKLGERYSEVQRKVNEMARNGEH

SEQ ID NO: 2543 - protein, 163 aa, unidentified
  REGION 1..163: note = Bacteroidales bacterium
MWGILIMLVVIAVVAFLFLKPNDSENEISDTSETIAQNTNNAQIEEVEQLVSESVPNKESIPVVKEYNSNNETRDNNGNKPTSVSEQKERSQATTETITHTKEVSSKINQKEEINPIGSIEEKALLVIRGNFGNGEERKAKLGAEYSAIQSKVNEMYANGLVH

SEQ ID NO: 2544 - protein, 215 aa, unidentified
  REGION 1..215: note = Bacteroidales bacterium
MANNSNKFDLNKTSGRKFDLNKASGRKFDLSKDDNDNNVISSSKENITTPYTQSSKKKWPYLVVGITIIAFIVWGLIQFGGDSEGSDANTITTKTVTTDSAEAVNTKDNSTEESNIGYDSQQQNALANNEVVGNEIPSKKESQNIENTTPSSTLNTSKTSNNNNETTITSNIEEKALLVIRGNFGNGEERKAKLGAEYSAIQSKVNEMYANGLVH

SEQ ID NO: 2545 - protein, 61 aa, Bifidobacterium indicum
MGDAGSVAAAVVRGEYGNDPQRHALLGNRYDEVMAVVNERLRGNTGGAPGAAPMWCVPATD

SEQ ID NO: 2546 - protein, 194 aa, unidentified
  REGION 1..194: note = Bacteroidaceae
MGNSDVRLKHKVQLRRKVDDSKLADKSSIENSTTRPTSDAPKSRKMIWLIIGVIVLCFLGYFIFSKPDNDGQKPVVVEDKTEVENISVPSDTTNSKEAVKEGVGETESEVVENSNNNVDESTAMVESVKPTETTTIDNAKTSVRTTNVSNDVEAEAMKVIRGDYGIGQERKNKLGDKYQTIQNRVNELKREGLF

SEQ ID NO: 2547 - protein, 228 aa, Prevotella fusca
MVEIKRKVTLRTKTPQPEEKPEDGITPKVKQPEPTPVPPPSTPSDETVGSKGGGNGKKWLVAAVLVALLGGGYYLYSSQGNESGNTAVAVATDSTGVRKDTTQTAQADSATKAETDTNGLNVTGKASSKNASENNSDGEVPVSSDNAPDVNTAANAATDKQVASAGNHGTSATTEPTMTEPAGSVQETANDVIKGTYGNGVTRKHKLGSRYAEVQKRVNEMYRKGEVH

SEQ ID NO: 2548 - protein, 183 aa, unidentified
  REGION 1..183: note = Bacteroides
MANSDVKLKHKVQLRRKVEEPTDEKPIVDPVPHSTRETSKSKMWIWVLVGIVVLLIIGYFIFTRSENTVQTPIEVESTFVPSDTNESIKVTSEETKGTEPKLSEENHTDIEDPSTSVAPTEPTPVTLPINTSVTNNVSNDVEAEAMKVIRGDYGVGQERKNKLGERYQTIQNRVNELKHEGVF

SEQ ID NO: 2549 - protein, 424 aa, Bifidobacterium longum
MIFNRGKPRHARPRRPWATMLATLLTTIALVFVPGTALADSGMDVSKWQGCVGSSQAATAKASGVNFAFVKVTEGNGYTDSVADCTMQSLKANGIRRGVYHFARPDLGNSPEAEADWFIGQTRGYVNDGVIPVLDWEPSGSYVTWSWWALRWLQRVESAWGVKPLIYTSASVIKMTDWTAVANANYGLWVAGYPRGYTGETLRNPGAVPYDVSPWPFAAAWQYSSSGHVPGVGERIDVNWFYGDAGTWSKYAGSQPGSSTNPATPSPTPQQGAPVGDAQSLATAVIRGDYGNDPQRRQLLGNRYAEVMAIVNQRLRGIGGTSTSASWYTVQRGDYLTLIGARTGVNWMSIANLNGLRAPYVIYPGQRLRITGTTSSTSAGTGRYVVIGAGDCLWNHFEANSAKIAAANGISNPNLVRAGTRIYY

SEQ ID NO: 2550 - protein, 501 aa, unidentified
  REGION 1..501: note = Caudoviricetes sp.
MASARKCATTSSTRTYRRTSNDTSHDRNRSVPGIACAHPHVQSRRAHALTSIFSKPRPPPTGWPFYLPLTWGRKERNLSILNKGKPKHMKPRRRWRTPLTALAVAASMAFAPAAMADMDGYDISNWQCGIDTASVPADFVIVGTTWGSGGVYGGCLSNGVNTDANRQLAGAINSGKETGVYHYARGDNPKAEARFFVDNVRGYVHKSVLILDWEAQDNTAWGDKQWPRRWAREVKRLTGVNPIIYTMDSGYWQVAGMETELNCGIWIAQYATNMVTGYQTAPWNLGARGEVMRQYTSNGSLSGWSGRLDLNRFRGDRAAWRKYANPDDKGTASLPNVKPTPQPTTAPTVDLNALATRTIRGDFGNDPARRQALGSNYAAVMDIVNRRLSGSGVTTPSGNAGSYCVVVSSGDTMGAIASRTGRTPASAWSVPSGNINRIWPGQQVCYGGSVASSVGAHVVTTSHVVTAGESLWKIYGSSWPAAAQRNGLRAPYTIYPGQVLH

SEQ ID NO: 2551 - protein, 278 aa, Streptococcus pyogenes
WGFRGQSAGAGGHVVMFIDADNIIHCNYANNNITIDNYNQTAAASGWMYSYVYRYTGAKAQPATNKSIDELVQEVLSGKHGSGEQRKISLGANYDAVQAKVNELLKQPQVAEQSPAVKQDGDLLFNGAVLKKAILDKILAKCKEHDILPSYAITVLHFEGLWGQSAVGRTDNNWGGMTWTGQGNRPSGVTVTQGTERPAVEGGHYMHYASVDDFLTDWFYLLRADGSYRVSGAKTFSEAVKGMFKVGGATYDYAASGFDSYIVGMAGRLKAIEQENGS

SEQ ID NO: 2552 - protein, 298 aa, Streptococcus pyogenes
NIIHCNYANNNITIDNYNQTAAASGWMYSYVYRYTGAKAQPATNKSIDELVQEVLSGKHGSGEQRKISLGANYDAVQAKVNELLKQPQVAEQSPAVKQDGDLLFNGAVLKKTVLDKILAKCKEHDILPSYAITVLHFEGLWGQSAVGRTDNNWGGMTWTGQGNRPSGITVTQGTERPAVEGGHYMHYASVDDFLTDWFYLLRADGSYRVSGAKTFSEAVKGMFKVGGATYDYAASGFDSYIVGMAGRLKAIEQENGSLAKYDQQTDIDVGLSDKIDVVIDSLEITINGVTYTATKKPI

SEQ ID NO: 2553 - protein, 152 aa, Streptococcus pyogenes
AQPATNKSIDELVQEVLSGKHGSGEQRKISLGTNYDAVQAKVNEMLKQPQVAEQSPAVKQDGDLLFNGAVLKKTVLDKILAKCKEHDILPSYAITVLHFEGLWGQSAVGRTDNNWGGMTWTGQGNRPSGITVTQGTERPAVEGGHYMHYASV

SEQ ID NO: 2554 - protein, 219 aa, Streptococcus pyogenes
AQPATNKSIDELVQEVLSGKHGSGEQRKISLGTNYDAVQAKVNEMLKQPQVAEQSPAVKQDGDLLFNGAVLKKTVLDKILAKCKEHDILPSYAITVLHFEGLWGQSAVGRTDNNWGGMTWTGQGNRPSGITVTQGTERPAVEGGHYMHYASVDDFLTDWFYLLRADGSYRVSGAKTFSEAVKGMFKVGGATYDYAASGFDSYIVGMAGRLKAIEQENGS

SEQ ID NO: 2555 - protein, 200 aa, Streptococcus pyogenes
NEDWDSQRADIAIWGFRGQSAGAGGHVVMFIDADNIIHCNYANNNITIDNYNQTAAASGWMYSYVYRYTGAKAQPATNKSIDELVQEVLSGKHGSGEQRKISLGANYDAVQAKVNELLKQPQVAEQSPAVKQDGDLLFNGAVLKKAILDKILAKCKEHDILPSYAITVLHFEGLWGQSAVGRTDNNWGGMTWTGQGNRPS

SEQ ID NO: 2556 - protein, 317 aa, unidentified
  REGION 1..317: note = Candidatus Saccharibacteria bacterium
MLKGIDISHWQANLDIASTGAEFVICKATQGTTFVDPSCDRHYQIAKRLGLKLGVYHYASGGDPVAEADFFVRNIQGYIGEAILILDWEKTQNSRFHEHASWCIKWLNRVKELTGVKPLIYTSASVIHEANWSSVVAGDYGLWVAGWPDNRDSWDIPKFLWDVSPWPFYALWQYTSSGGRLDRDVFMGDRTAWDKYAARNGSTPTPAPAPAPAAKSNEDLATEVIRGDWGNGQDRKNRLTAAGYDYGAVQSIVNQRLAGSSGASTANNCSAVYYTVQKGDTLWGIAQKYGTTYQEIARLSGIANPNLIYPGQRVRVK

SEQ ID NO: 2557 - protein, 315 aa, unidentified
  REGION 1..315: note = Candidatus Saccharibacteria bacterium
MLKGIDISHWQANLDIASTGAEFVICKATQGTTFVDPSCDRHYQIAKRLGLKLGVYHYASGGDPVAEADFFVRNIKGYIGEAILILDWEKTQNGRYHEHASWCLKFLNRVKELTGVKPLIYMSASVIKVADWSKVVADDYGLWVAGWPDNRDSWDIPDFRWDVRPWPFYALWQYTSSGGRLDRDVFMGDRTAWDKYAAINGQPVDPSPAPAPAGKSNEELATEVIRGDWGNGQDRKNRLTAAGYDYNAVQSIVNQRLGGGSSNSGGSGEVWYTVKSGDTLWAIAQRYGTTYQEIARLSGISNPNLIFPGQRVRVK

SEQ ID NO: 2558 - protein, 254 aa, unidentified
  REGION 1..254: note = Clostridia bacterium
MITARQMFCPQDKKAVKFPHQMTPTRIVVHNTANDASANNEITYMNRNNNQVSFHFAVDDKEVVQGLPLDVNGWHAGDGAHGKGNREGIAVEICYSKSGGARFDAAERLAAQFIAQLLKQYGWGIDRVTKHQDYSGKYCPHRTLDRGWDRFLDMIRAELKEPGEDVVQAVIAGRYGNGEDRKKRLAAAGYDYNEVQRQVNERLGITSAKNVKSIDELAREVIRGEWGNGADRKNRLTAAGYDYNSVQRRVNELL

SEQ ID NO: 2559 - protein, 125 aa, unidentified
  REGION 1..125: note = Candidatus Saccharibacteria bacterium
TAWDKYAAVNGQPVNPSPAPAPAGKSNEELATEVIRGDWGNGQDRKNRLTAAGYDYNAVQSIVNQRLGGGSSNSGGSGEVWYTVKSGDTLWAIAQRYGTTYQEIARLSGIPDPNKIWPGQRVRVK

SEQ ID NO: 2560 - protein, 154 aa, unidentified
  REGION 1..154: note = Bacteroidales bacterium
MRTGEEKYMADGGDINTINPFRLKEANSFANGGRMSRKAAEATRGNARLVKKREEDDDDAYFQDTPRGGSDIDTLAVRVMRGDLGTGEQLRRNLGTKYQAVQRRVKQLMASQGGMMGDDVDEFADDELSENAFANGGRLSRITRPNDKRYEIYF

SEQ ID NO: 2561 - protein, 239 aa, unidentified
  REGION 1..239: note = Erysipelotrichaceae bacterium
MITAQEFRNQYLGKAIDVDGAYGAQCVDLFKQVCYLAGMKPFALGGSGYAEEIVKRYQPLGLNAYFTLVSLSNAQYGDWIVWSKGSHDCPDSHVAMFIRMDGVNRVMVFGQNQFGKAYGNEGSISTHGIIGVLRFKAWSIQSTRKTNEELAQEVIEGLWGNGSERKSRLISAGYDYDAIQAIVNQKINDNVSKLSKTIDQLADEVILGKWGNGKNRISRLKKAGYSPSTIQTRVNQKLK

SEQ ID NO: 2562 - protein, 411 aa, unidentified
  REGION 1..411: note = Lachnospiraceae bacterium
MIYQTLPWNHRGWHAGSSINGSANNTHIGVEMCEPATIKYTSGFGFKVTNEADAKAVAKRTYEAAVELFAMLCKTYNLDPLGDGVIISHTEGHKRGIASNHGDPEHLWKGLGLPYTMNGFRADVKAAMGINEAAPVKEAGTMTEKELWDYFKSKGMNDYGVAGLLGNLYAESGLRANNLQNSFEKKLNITDEEYTRLVDGGNYPDFITDKAGYGLAQWTYHSRKQYLLKKSQEMGTSIGDARMQCEYLMWELETSYPSVFRTLKYAKSVREASDVVLMNFERPADQSEKVQVKRATYGQGYYDKYAGKAAAEPKVEQPTKTTDELAAEVIKGLWGNGEECKQRLTAAGYDYKTVQNRVNELCKKPETKTTDELAREVIKGMWGNGAERKKRLTEAGYDYKTIQNRVNELCK

SEQ ID NO: 2563 - protein, 641 aa, Bifidobacterium pullorum
MESIIVACITGVVTLVGVILSNSKSRAVMEVKLDALTAKVEKHNQVLERTYRLEQDMAVAKHDIEEIKGRWHEMSEFLASNEWQWRLLRTIVQGVLGVVITNLDLILGWCVLDPSMRALVVALVMAVLSPSWRLSAEATRRSSSRRAAAMGLNGIDISSWQEDLVVSAMTTCDFVIVKATGGAGYTNECFRRHCDETLATGKLLGCYHYARDRGYEGSAEAEADHFIAAFKPYVGKAIPFLDWEADALNLGVAWAKKWFDRVRDKTGVTPGIYTSKSVLFSYDWSSVAKTYPLWVAQYPNYEETGFLSEPWTDGWDFGAWKDPLIFQYTGTGRIPGYGGHLDLDLFYGTKDDWRGRCAVVGASAGTREADTVSISRANVAAQIMEHLCTCSEHGYSQPGRHGTSGHCNVKTDAGTIKVTKGDRDCSSAVCEAWELALAGSAYDGLITRYNWTGGMREMFVGSGLFSWKPVSFIASRGDIYLDEEHHTAMCIRNDGTADLLGEFSISETGGIDGEPGDQTGRESWVHDYYSGSWDGILHYNGKADVGSESTPTGSGAPSGDVSELAARVIAGDFGNGDARRAALGSRYDEVQAEVNRILSGGSSSSSYDVDALARRVIAGEFGNGDARSRLWGRSTRPCRSA

SEQ ID NO: 2564 - protein, 492 aa, Bifidobacterium pullorum
MGLNGIDISSWQEDLVVSAMTTCDFVIVKATGGAGYTNECFRRHCDETLATGKLLGCYHYARDRGYEGSAEAEADHFIAAFKPYVGKAIPFLDWEADALNLGVAWAKKWFDRVRDKTGVTPGIYTSKSVLFSYDWSSVAKTYPLWVAQYPNYEETGFLSEPWTDGWDFGAWKDPLIFQYTGTGRIPGYGGHLDLDLFYGTKDDWRGRCAVVGASAGTREADTVSISRANVAAQIMEHLCTCSEHGYSQPGRHGTSGHCNVKTDAGTIKVTKGDRDCSSAVCEAWELALAGSAYDGLITRYNWTGGMREMFVGSGLFSWKPVSFIASRGDIYLDEEHHTAMCIRNDGTADLLGEFSISETGGIDGEPGDQTGRESWVHDYYSGSWDGILHYNGKADVGSESTPTGSGAPSGDVSELAARVIAGDFGNGDARRAALGSRYDEVQAEVNRILSGGSSSSSYDVDALARRVIAGEFGNGDARSRLWGRSTRPCRSA

SEQ ID NO: 2565 - protein, 406 aa, Streptococcus dysgalactiae
MTVDTEKAIAWMGLKEGRVSYSMDYRNGPDSYDCSSAICSALIYAGASNPGWLLNTEYMHDWLVQNGYELIAENEDWDSQRADIAIWGLRGQSAGAGGHVVMFIDADNIIHCNYANNNITIDNYNQTAAASGWMYSYVYRYTGAKAQPATNKSIDELVQEVLSGKHGSGEQRKISLGANYDAVQAKVNEMLKQPQVAEQSPAVKQDGDLLFNGAVLKKAILDKILAKCKEHDILPSYAITVLHFEGLWGQSAVGRTDNNWGGMTWTGQGNRPSGVTVTQGTERPAVEGGHYMHYASVDDFLTDWFYLLRADGSYRVSGAKTFSEAVKGMFKVGGATYDYAASGFDSYIVGASSRLKAIEAENGSLDKFDAVSNIVSSTDPDKIEVTIEGIEVSINGVTYQLTKKPV

SEQ ID NO: 2566 - protein, 309 aa, unidentified
  REGION 1..309: note = Clostridium sp. AM51-4
MTTERKTFIENIAAAARKHAANYGIAVISPIIAQAINESGWGKSTLAAKYHNYFGMKCGSAWKGKSVNMSTCEEYEVGVLTQIKDNFRVYDSLEEGVKGYFDFISASRYANLKGVTDPKTYIENIKADGYATSSQYVKNLLNLVSAYNLTQYDNITAQQGKKSVAEIAQEVIAGAWGNGTERKEKLEAAGYNYAEVQAIVNERAGNKTDNKADNKKSIAEIAQEIVAGKWGNGSERKQRLEAEGYNYAEVQAAVNNIMGKSEPSKKNVAEIAKEVISGKWGNGSERKQRLEAAGYNYAEVQAKVNEMLR

SEQ ID NO: 2567 - protein, 315 aa, unidentified
  REGION 1..315: note = Lacticaseibacillus daqingensis
MTFSKLTTYVDTRPMNGSPANSATYPRHKIDRIVIHHNSGTNYKGALDTWLVGGPANTSAHYEITPTMIIGCVEEERSAWHAGNKLMNQRSIGLEHVNSAGAPGWPVAEETLKNSAKLCADLCDRYDIPIDATHIVPHNSVVPTDCPGGINMSHYIDLVRQAAGQPATTPTPTPAPSGKTITQLAAEVIAGKYGSGDARKAALGSQYAAVQAEVNRQLGGTASAPKPAPAPSNWHAQTGSFTITTSPGIKLRSGSASTSASLLAVLPKGSVVKYDAYGYFDGYVWIRQPRSGGYGYLPTGTASGTKRTSYWGSFK

SEQ ID NO: 2568 - protein, 376 aa, Streptococcus pyogenes
DSYDCSSAICSALIYAGASNPGWLLNTEYMHDWLVQNGFELIADNEDWDSQRADIAIWGFRGQSAGAGGHVVMFIDADNIIHCNYANNNITIDNYNQTAAASGWMYSYVYRYTGAKAQPATNKSIDELVQEVLSGKHGSGEQRKISLGTNYDAVQAKVNEMLKQPQVAEQSPAVKQDGDLLFNGAVLKKTVLDKILAKCKEHDILPSYAITVLHFEGLWGQSAVGRTDNNWGGMTWTGQGNRPSGITVTQGTERPAVEGGHYMHYASVDDFLTDWFYLLRADGSYRVSGAKTFSEAVKGMFKVGGATYDYAASGFDSYIVGMAGRLKAIEQENGSLAKYDQQTDIDVGQSDKIDVVIDSLEININGVTYTATKKPI

SEQ ID NO: 2569 - protein, 282 aa, Streptococcus pyogenes
YNQTAAASGWMYSYVYRYTGAKAQPATNKSIDELVQEVLSGKHGSGEQRKISLGTNYDAVQAKVNEMLKQPQVAEQSPAVKQDGDLLFNGAVLKKTVLDKILAKCKEHDILPSYAITVLHFEGLWGQSAVGRTDNNWGGMTWTCQGNRPSGITVTQGTERPAVEGGHYMHYASVDDFLTDWFYLLRADGSYRVSSAKTFSEAVKGMFKVGGATYDYAASGFDSYIVGMAGRLKAIEQENGSLAKYDQQADIDVGQSDKIDVVIDSLEININGVTYTATKKPI

SEQ ID NO: 2570 - protein, 405 aa, Streptococcus dysgalactiae
MAIETEKAVAWMQSKKGCVSYSMTYRNGPNSYDCSSSVCSALIYAGASNPGWLLNTEYMHDWLVKNGYTLIAENDGWDSQRGDIFIWGQRGQSAGAGGHTGMFVDADNIIHCNYARNNITIDNYNQTAAASGWMYSYAYRYNGEQSQPITNKSIDELAQEVLAGQHGSGEQRKISLGANYDAVQAKVNDLLKQPKVAEQSPAVKQDGDLLFNGVVLKRAILDKILAKCKEHDILPSYAITVLHFEGLWGQSAVGRADNNWGGMTWTGQGNRPSGITVTQGTSRPLNEGGHYMHYESVDDFLTDWFYLLRAGGSYKVSGAKTFSEAVKGMFIIGGAKYDYAASGFDSYIVGMASRLKAIEQENGPLSKYNQQTDINVGQSDKIDVVIDSLEITINGVNYTATKKPI

SEQ ID NO: 2571 - protein, 479 aa, Streptococcus suis
MTINLETSIRWMSDRIGKVSYSMDYRNGPNSYDCSSAVYYALMSAGAISAGWAVNTEYMHDWLIRNGYVLVAENKPFNAQRHDVCILGKRGYSSGAGGHVVIFVDNVNVIHCNYARNGIAIDNYNQVHRGMYYYLYRPTNQPSISNKSLDQLVKETLAGLHGNGDARKASLGNQYEAVMAVINGKATASQKSIDELAQEVIAGKHGNGEARKQSLGADYPAVQKSVTEILKGSTSGNTPKTPLDAPKSEVVNSSTEPKTEETRATGKVTEPKIVKEAGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSDAVKGMFKVGGAVYDYAATGYENYLVGMSSRLKAIEAENGSLAKYDQQTVTDVAKIDKIEVAIEGIEVTINGTRYRLTKEPI

SEQ ID NO: 2572 - protein, 426 aa, unidentified
  REGION 1..426: note = uncultured Bifidobacterium sp.
MIFNKGKPKHKSMNPRRRWRKLLTALMVVISMAFAPAAMADLNGYDISNWQCGIDTATVPADFVIVGTTWGSGGVYGGCLSNGVNTDANRQLAGAINSGKETGVYHYARGGDPEAEARFFVDNVRGYVRKSVLILDWEAQDNKAWGDKQWPRRWAREVKRLTGVNPIIYTMDSGYWQVAGMEKELDCGIWIAQYATNLVTGYQTAPWNIGARGEVMRQYTSNGSLSGWSGRLDLNKFRGDRTAWRKYANPDDKGTTSLPNVKPKPQPTTAPAVDLNALATRTIRGDFGNDPARRQALGGNYAAVMRIVNSRLAGSSGNVSGATGGAYCVVVGSGDTMSAIASRSGRTPASAWNVPSGNINRIWPGQRVCYGGSTASSVGARVTGTSHVVTAGESLWAIYGASGWQAAAQRNGLHTPYTIHPGQVLR

SEQ ID NO: 2573 - protein, 426 aa, Bifidobacterium catenulatum
MSILNKGKPKPKHMKPRRRWRTPLTALAVAVSMAFAPAAMADMDGYDISNWQCGIDTATVPADFVIVGTTWGSGGVYGGCLSNGVNTDANRQLAGAINSGKETGVYHYARGGDPETEARFFVDNVRGYVHRSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTAGLPDVKPTPQPTAAPTVDLDALATRTIRGDFGNDPARRQALGSNYASVMAIVNRRLSGSGVTTLSGNAGSYCVVVSSGDTMGAIASRTGRTPASAWSVPSGNINRIWPGQQVCYGGSTASSIGAHVVTTSHVVTAGESLWKIYGSGWPAAAQRNGLRAPYTIYPGQVLH

SEQ ID NO: 2574 - protein, 412 aa, unidentified
  REGION 1..412: note = Streptococcus iniae SF1
MHDWLIKNGYELIAENVDWEAKRNDIAIWGERGYSSGAGGHVVMFIDADNIIHCNWARNGITIDNYNATAAASGWMYCYVYRLKGGETSSTSEKSLDTLVKETLAGTYGNGDQRKAALGNQYEAVMAVINGKATTSQKTVDELAQEVIAGKHGNGETRKKSLGNQYEAVQKRVTELLKKQSSEPSNAQEVKQPTETKTSKTEPTGKATVSKEDGDLSFNGAILKKSVLDNILANCKKHDILPSYALTILHYEGLWGTSAVGKTDNNWGGMTWTGQGQRPSGVTVTQGSARPSNEGGHYMHYASVDDFLTDWFYLLRSGGSYKVSGTKTFSEAVKGMFKTGGAVYDYAASGFDSYIVGASSRLKAIETENGSLDKFDKATDIGDGSKDKIDITIEGIEVTINGITYELTKKPV

SEQ ID NO: 2575 - protein, 97 aa, unidentified
  REGION 1..97: note = Firmicutes bacterium CAG:308
MVLTVHRWFANKSCPGDWLYARLGDLAKKVTANLSGSSAVKKDTSSEKKNSGTKSVDQVAREVIQGKWGNGTDRKKRLTAAGYNYNAVQKRVNGLLK

SEQ ID NO: 2576 - protein, 296 aa, unidentified
  REGION 1..296: note = Caudoviricetes sp.
MNGIDIASYQRGIDLSQIPADFVIVKATENVGYVNPDFTRAIKQGLTLGKKMGIYHYAGGSDPVREAKFFLKIIEPYIGKAILCLDWESTNNASYGRNDAAWCMRFMDYVYDVTGVKMFLYISAGLSKRFAKVLEKYHFWAAQYANYKMLRDFQEHPWNEGKYECDIRQYSSCLWLPGWRSRLDANKAYITPAEWDAAASVAEEATEEVTVDELAQEVLNGKWGNGDERKKLLEEAGHNYDEVQSRVNAIVADEEITALAWRVIAGEFGNGLEREKRLGDKYRAVQDRVNKLYIGD

SEQ ID NO: 2577 - protein, 250 aa, unidentified
  REGION 1..250: note = Caudoviricetes sp.
MVNTELAISFMADLEGNVSYSMARREGPSSYDCSSAIYYALRAGGASPAAWTVNTETEHDWLIANGYYLFAENEDWDMQRGDVIIWGPKGQSLGAGGHTMLALDADNVIHCTYAANGVTRNNYNQLYGWNAGTMGGPYVYVYRQNGTTPQKSESVQQGTPPEAAAGTLEQLAGEVMAGKYGSGEERKAALGSKYAAVQTIVNERLEAIDASTSHNRLADEVLAGHLGNGDERRANLGTYYNAVQNIVNSR

SEQ ID NO: 2578 - protein, 313 aa, unidentified
  REGION 1..313: note = Bacteriophage sp.
MRGIDISKWQSGIDLSAVNADFVIVKATEGIGYVDKSCDGFFQKALSLGKKLGFYHFARPTNDAVREAEYFYSNCRGYFGKGIPILDWESGNTSNVAWAKRWLDRVYQLSGVKPVIYMSESVVNANNWSAVAAADYGLWVAKYCDNNPDYNYSMANAGNRPHVKWWKFYCMWQWTSTGRLNGYSGNLDCNVFYGDGSTWDAYVGKSTSVTKPQPKPAAKTTSQLADEVIAGQWGNGSDRKKRLNAAGYDYNAVQNAVNQKMAKQTAHVYYVVKRGDTLSAIACKYGTTYQRLAQINGIANPNKIYAGQKIRVK

SEQ ID NO: 2579 - protein, 479 aa, Streptococcus suis
MEQAIAWMEARRGKVTYSMDYRNGPNSYDCSSSVYFALMSAGAITAGWAVNTEYMHDWLIKNGFKLIAENSVFAAQRGDIFIWGKRGQSSGAGGHTGIFVDSNNIIHCNYARNGITVDNYLATARASGNMYYYIYRPSGQSTVSTSTAGKSIDQLVKETLAGKYGNGDSRKAALGNQYEAVMAVINGKATAPKKTVDQLAQEVIQGKHGNGEDRKKSLGPDYDTVQKRVTEILKGSTSGNTPKTPSDAPKNELVNSTTEPKKAETGTTGKATDTKITKEDGDLSFNGAILKKSVLDVILAKCKEHNILPSYAITVLHFEGLWGTSAVGKADNNWGGMTWTGKGERQSGVTVTQGTARPANEGGHYMHYASVDDFLTDWFYLLRSGGSYKVSGAKTFSEAIKGMFKTGGAVYDYAATGYDNYLVGMSSRLKAIEAENGSLSKYDTATVTDVGSTDKIEVNIEGIEISINGVTYTLSKKPV

SEQ ID NO: 2580 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGSLDKFDKQTVSDVVQSDNIEINVEGIEVIINGETYRLEKKPV

SEQ ID NO: 2581 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2582 - protein, 468 aa, Streptococcus suis
MGVNIETALRWMSDRKDRVTYSMDYRNGPNSFDCSSSVYYALMSAGAISAGWAVNTEYEHDWLIKNGYKLIAENTDWDARRGDIFVWGRRGQSAGAGGHTGIFVDPDNIIHCNYARNGITVDNYNQTAAASGWMYCYVYRLANQTSTAGKSLETLVQETLAGKYANGDTRKAALGNQYEAVMAVINGKASASQKSVDELAQEVIQGKHGNGEARKQSLGADYPAVQKRVTELLKKQPSEPSKAQEVKQPTETKTSQTEPTGNATVNKEEGDLSFNGAILKKAVLDKILANCKNHDILPSYALTILHYEGLWGTSAVGKADKNWGGMTWTGQGNRPSGVTVTQGSARPSNEGGHYMHYATVDDFLTDWFYLLRAGGSYKVAGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2583 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDNYNQTAAASGWMYCYVYRLVNQTSTSGKSLETLVQETLAGKYGNGDQRKAALGNQYEAVMAVINGKATAPKKTVDQLAQEVIAGKHGNGEARKQSLGADYPAVQKRVTELLKKQPSEPSKSSEVKQVTKTKTSQTEPTGNATVNKEEGDLSFNGAILKKAVLDKILANCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSESVKGMFKVGGAVYDYAASGFDSYIVGASSRLKAIESENGSLDKFDKQTVTDVGQSDDIEINVEGIEVIINGETYKLEKKPV

SEQ ID NO: 2584 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSEAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2585 - protein, 473 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGGTSGNTPKTPSDAPKSEVVNSSTEPKTEETESTGQATESKEDGDLSFNGAFLKKAVLDKILANCKKHDILPSYAITVLHFEGLWGTSAVGKADNNWGGMTWAGQGNRPSGVTVTQGSARPSNEGGHYMHYASVDDFLTDWFYLLRSGGSYKVSGAKTFSEAVKGMFKISGAVYDYAATGYDNYLIGMSSRLKAIESENGSLAKYDQQTVTDLAKTDKIEVAIEGIEVTINGTRYKLTKEPI

SEQ ID NO: 2586 - protein, 465 aa, Streptococcus suis
MTINLETSIRWMSDRIGKVSYSMDYRNGPNSYDCSSAVYYALMSGGAISAGWAVNTEYMHDWLIRNGYVLVAENKPFNAQRHDVFILGKRGYSSGEGGHTGIFVDNVNIIHCNFKRNGITIDDYNKVSRGMYYYLYRPTNQPSISNKSLDQLVKETLAGVHGNGDARKASLGNQYEPVMAVINGKATTNQKTVDQLAQEVIAGKHGNGEARKKSLSSQYEAVQKRVSELLKKQPSEPLKSPEVKQATESKSSQTEPTRQATESKEEGDLSFNGAILKKVVLDKILANCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAVKGMFKVGGAVYDYAASGFDSYIVGASSRLKAIEQENGSLAKYDIATVTDVAKTDKIEVAIEGIEVTINGTRYRLTKEPI

SEQ ID NO: 2587 - protein, 470 aa, Streptococcus suis
MGVNIETALRWMSDRKGRVTYSMDYRNGPNSFDCSSSVYYALMSAGAISAGWAVNTEYEHDWLIKNGYTLVAENTDWDAKRGDIFIWGRRGQSAGAGGHTGIFVDPDNIIHCNYARNGITVDNYNQTAAASGWMYCYVYRLANQSTPSPSGKDLNTLVQETLAGKYGNGDQRKAALGNQYEAVMAVINGKATAPKKTVDQLAQEVIAGKHGNGEARKQSLGADYPAVQKRVTELLEKQPSEPSKAQDVKQPAETKTSQTEPTGNTTASKEDGDLSFNGAILKKAVLEKILANCKKHDILPSYALMILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2588 - protein, 479 aa, Streptococcus suis
MTINLETSIRWMSDRVGKVSYSMDYRNGPNSYDCSSAVYYALMAGGAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGEATAPKKTVDQLAQEVIAGKHGNGEARKQSLGADYPAVQKRVTEILKGSTSGNTPKTPSDAPKSEVVNSSTEPKTEETRATGKATDTKITKEDGDLSFNGAILKKSVLDIILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGSLAKYDQQTVTDVGSSDKIEVNVEGIEVIINGETYKLEKKPV

SEQ ID NO: 2589 - protein, 469 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNWSRKGISIDNYNNTAAASGWMYCYVYRLANQTSTSGKSLETLVQETLAGKYGNGDQRKAALGNQYEAVMAVINGKATAPKKTVDQLAQEVIQGKHGNGEARKKSLGADYPAVQKRVSELLKKQPSEPSNSQEVKQVTESKTSQTEPTGQATESKEDGDLSFNGAILKKAVLEKILTNCKKHDILPSYALTILHYEGLWGTSAVGKADNNWGGMTWTGQGNRPSGVTVTQGSARPSNEGGHYMHYATVDDFLTDWFYLLRKDGPYKVSGALTFSESVKGMFQVGGAKYDYAAAGYDSYLVGATSRLKAIESENGSLTRFDATSNNVHSVDPDKISVDIDGIEVTINGVVYKLEKKPV

SEQ ID NO: 2590 - protein, 464 aa, Streptococcus suis
MAINLEASISWMNDRVGKVTYSMDYRNGPNSYDCSSAVYYALMAGGAISAGWAVNTEYEHDWLIRNGYVLVAENKPFDAKRHDIFIWGKRGYSSGGGGHTGIFVDNVNIIHCNFKRNGITIDDYNKVSRGMYYYLYRPTQPSTSNKSLDQLVKETLAGKYGNGEQRKASLGNQYQAVMDRINGKTTASQKSVDQLAQEVIQGKHGNGEARIKSLGSQYESVQKRVTELLKKQPSKPSKSSEVKQPTETKISQTKPTEKATASKEEGDLSFNGAILKKAVLDKILANCKKHDILPSYAITVLHFEGLWGTSAVGKADNNWGGMTWTGQGNRPSGVTVTQGSARPSNEGGHYMHYATVDDFLTDWFYLLRAGGSYKVSGSKTFSEAVKGMFKFGGAVYDYAASGYDNYLVGMSSRLKAIESENGSLAKYDTATVTDVGSTDKIEVNIEGIEISINGVKYAISKKPV

SEQ ID NO: 2591 - protein, 469 aa, Streptococcus suis
MGVNIETALRWMSDRKDRVTYSMDYRNGPNSFDCSSSVYYALMSAGAISAGWAVNTEYEHDWLIKNGYKLIAENTDWDARRGDIFVWGRRGQSAGAGGHTGIFVDPDNIIHCNYARNGITVDNYNQTAAASGWMYCYVYRLANQTSTAGKSLETLVQETLAGKYANGDTRKAALGNQYEAVMAVINGKASASQKSVDELAQEVIQGKHGNGEARKQSLGADYPAVQKRVTELLKKQPSEPSKAQEVKQPTETKTSQTEPTGNATVNKEEGDLSFNGAILKKAVLDKILANCKNHDILPSYALTILHYEGLWGTSAVGKADNNWGGMTWTGQGKRPSGVVVTQGLARPSNEGGHYMHYASVDDFLTDWFYLLRSGGSYKVSGAKTFSDAVKGMFKIGGAVYDYAASGFDSYIIGASSRLKAIESENGSLTRFDATSNNVHSVDPDKISVDIEGIEVTINGVVYKLEKKPV

SEQ ID NO: 2592 - protein, 408 aa, Streptococcus suis
ENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2593 - protein, 480 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNRYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYATVDDFLTDWFYLLRAGGSYKVSGAKTFSDAVKGMFKVGGAAYDYAASGFDSYIVGASSRLKAIESENGSLTRFDATSNNVHSVDPDKISVDIDGIEVTINGVVYKLEKKPV

SEQ ID NO: 2594 - protein, 326 aa, Streptococcus suis
KETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2595 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGISIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2596 - protein, 480 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYATVDDFLTDWFYLLRAGGSYKVSGAKTFSDAVKGMFKVGGAAYDYAASGFDSYIVGASSRLKAIESENGSLTRFDATSNNVHSVDPDKISVDIDGIEVTINGVVYKLEKKPV

SEQ ID NO: 2597 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWVAKRGDIFIWGRRGQSAGAGGHTGIFIDPDNIIHCNYARNGITVDNYNQTAAASGWMYCYVYRLANQTSTAGKSLETLVQETLAGKYGNGEQRKAALGNQYEPVMAVINGKATAPKKTVDQLAQEVIAGKHGNGEARKQSLGADYPAVQKRVTELLKKQPSEPSKAQEVKQPTETKTSQTEPTGNATVNKEEGDLSFNGAILKKAVLDKILANCKKHDILPSYALTILHYEGLWGTSAVGKADNNWGGMTWTGQGNRPSGVVVTQGLARPSNEGGQYMHYATVDDFLTDWFYLLRAGGSYKVSGAKTFSEAVKGMFKVGGAVYDYAASGFGSYIVGASSRLKAIESENGTLSKYDTATVTDVGSKDHIDITIDGIEVIINGETYKLEKKPV

SEQ ID NO: 2598 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWVAKRGDIFIWGRRGQSAGAGGHTGIFIDPDNIIHCNYARNSITVDNYNQTAAASGWMYCYVYRLANQTSTAGKSLETLVQETLAGKYGNGDQRKAALGNQYEAVMAVINGKTTAPKKTVDQLAQEVIAGKHGNGEARKQSLGADYPAVQKRVTELLKKQPSEPSKAQEVKQPTETKTSQTEPTGNATVNKEEGDLSFNGAILKKSVLDVILVKCKEHNILPSYAITVLHFEGLWGTSAVGKADNNWGGMTWTGQGNRPSGVTVTQGSARPSNEGGHYMHYATVDDFLTDWFYLLRAGGSYKVSGAKTFSEAVKGMFKVGGAVYDYAASGFDSYIVGASSRLKAIESENGTLSKYDTATVTDVGSKDNIDITIDGIEVIINGETYKLEKKPV

SEQ ID NO: 2599 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTAGKSLETLVQETLAGKYGNGDTRKAALGNQYEAVMAVINGKATAPKKTVDQLAQEVIAGKHGNGEARKQSLGADYPAVQKRVTELLKKQPSEPSKSSEVKQTTETKTSQTEPTGKAIVGKEEGDISFNGAILKKAVLEKILANCKKHDILPSYALTILHYEGLWGTSAVGKADNNWGGMTWTGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 2600 - protein, 467 aa, Streptococcus suis
MAVNIEAAIAWMSARAGKVTYSMDYRNGPGSYDCSSSVYYALMSAGAITAGWAVNTEYEHDWLVKNGYTLIAENSVFAAQRGDIFIWGRRGQSSGAGGHTGIFVDSNNIIHCNYARNGITIDNYNQTAAASGWMYCYVYRLANQSSTSTTGKSLDTLVKETLAGVYGNGDTRKAALGNQYEAVMSVINGKTTAPKKSVDQLAQEVIAGKHGNGEDRKKSLGADYPAVQKRVTEILSGNSTQEAPKQPSEPSKVEVEQLATVSKEEGDLSFNGAVLKKSVLDKILAKCKEHDILPSYAITVLHFEGLWGTSAVGKADNNWGGMTMTSDVDNITRKSGVIVTRGSARPANEGGYYMHYATVDDFLTDWFYLLRAGGSYKVSGAKTFSEAVKGMFKVGGAAYDYAASGYDNYIVGMSSRLKAIEAENGSLAKFDVATVENVGSTDKIEVNIEGIEMSINGVTYTISKKPV

SEQ ID NO: 2601 - protein, 480 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2602 - protein, 479 aa, Streptococcus suis
MTINLETSIRWMSERVGKVSYSMDYRNGPNSYDCSSAVYYALMSGGAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGEATAPKKTVDQLAQEVIAGKHGNGEARKQSLGADYPAVQKRVTEILKGSTSGNTPKTPSDAPKSEVVNSSTEPKTEETRATGKATDTKITKEDGDLSFNGAILKKSVLDIILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGSLAKYDQQTVTDVGSSDKIEVNVEGIEVIINGETYKLEKKPV

SEQ ID NO: 2603 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNSITVDNYNQTAAASGWMYCYVYRLANQTSTSGKSLETLVQETLAGKYGNGDQRKAALGNQYEAVMAVINGKATAPKKTVDQLAQEVIAGKHGNGEARKQSLGADYPAVQKRVTELLKKQPSEPSKAQEVKQPTETKTSQPDPTGKAIVSKEDGDLSFNGAILKKAVLDKILANCKKHDILPSYALTILHYEGLWGTSAVGKADNNWGGMTWTGQGNRPSGVTVTQGSARPSNEGGHYMHYATVDDFLTDWFYLLRAGGSYKVSGAKTFSEAVKGMFKVGGGVYDYAASGFDSYIVGASSRLKAIETENGSLDKFDKQTVTDVGQSDDIEINVEGIEVIINGETYKLEKKPV

SEQ ID NO: 2604 - protein, 479 aa, Streptococcus suis
MTINLETSIRWMSERVGKVSYSMDYRNGPNSYDCSSAVYYALMSGGAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGEATAPKKTVDQLAQEVIAGKHGNGEARKQSLGADYPAVQKRVTEILKGSTSGNTPKTPSDAPKSEVVNSSTEPKTEETRATGKATDTKITKEDGDLSFNGAILKKSVLDIILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGSLAKYDQQTVTDVAKTDKIEVAIEGIEVTINGTRYKLTKEPI

SEQ ID NO: 2605 - protein, 480 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSCGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2606 - protein, 476 aa, Streptococcus suis
MTINLETSIRWMSDRVGKVSYSMDYRNGPNSYDCSSAVYYALIAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILTKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTLSEAVKGMFKTGGAVYDYAASGFDSYIVGASSRLKAIEAENGSLAKYDQQTVTDVAKTDKIEVAIEGIEVTINGTRYKLTKEPI

SEQ ID NO: 2607 - protein, 226 aa, Streptococcus suis
YNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGV

SEQ ID NO: 2608 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDNYNQTAAASGWMYCYVYRLANQTSTSDKSLETLVQETLAGRYGNGDQRKAALGNQYQAVMAVINGKATAPKKTVDQLAQEVIQGKHGNGEDRKQSLGADYPAVQKRVTELLKKQPSEPSKSSEAKQVTESKTSQTETTEKVTVSKEDGDLSFNGAILKKAVLDKILTNCKKHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKAGGAVYDYAASGFDSYIVGASSRLKAIESENGTLSKYDTATVTDVGSKDHIDITIDGIEVIINGETYKLEKKPV

SEQ ID NO: 2609 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVSELLKKQSSEPLNGQEVKQVAETKISQTEPTGQATAGKEEGDLSFNGAILKKSVLDVILAKCKEHNILPSYAIIVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIEAENGSLAKYDTATVTDVGSTDKIEVNIEGIEISINGVTYTLSKKPV

SEQ ID NO: 2610 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWVAKRGDIFIWGRRGQSAGAGGHTGIFIDPDNIIHCNYARNGITVDNYNQTAAASGWMYCYVYRLGNQTSTAGKSLETLVQETLAGKYGNGDTRKAALGNQYEAVMAVINGKVTASQKSVDELAQEVIAGKHGNGEARKQSLGADYPAVQKRVTELLKKQPSEPSKSSEVKQTTETKTSQTEPTGKAIVSKEEGDLSFNGAILKKAVLEKILANCKKHDILPSYALTILHYEGLWGTSAVGKADNNWGGMTWTGQGNRPSGVTVTQGSARPSNEGGHYMHYVTVDDFLTDWFYLLRSGGSYKVSGAKTFSEAVKGMFKAGGAVYDYAASGFDSYIVGASSRLKAIESENGTLSKYDTATVTDVGSKDHIDITIDGIEVIINGETYKLEKKPV

SEQ ID NO: 2611 - protein, 468 aa, Streptococcus suis
MTINLETSIRWMSDRVGKVSYSMDYRNGPNSYDCSSAVYYALMAGGAISAGWAVNTEYMHDWLIRNGYILVAENKPFNAQRHDVFIWGKRGYSSGEDGHTGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIAGKHGNGEARKQSLGTDYPAVQKRVTELLKKQPSEPLNGQEVKQVAETKISQTEPTGQATESKEDGDLFFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFSEAVKGMFKVGGAVYDYAATGYENYLVGMSSRLKAIEAENGTLSKYDTATVDNIGSTDKIEVNIEGIEISINGVTYTLSKKPV

SEQ ID NO: 2612 - protein, 396 aa, Streptococcus suis
VCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIQGKHGNGEARKQSLGADYPAVQKRVTEILKSDTSGNTPKTPSEAPKNEVVNSSTEPKTEETGATGKVTELKIVKEAGDLSFNGAILKKSVLDVILAKCKEHNILPSYAITVLHFEGLWGTSAVGKADNNWGGMTMISNDLQITRPSGVIVTRGLARPSNEGGYYMHYASVDDFLTDWFYLLRAGGSYKVSGAKTFSDAVKGMFKVGGAVYDYAATGYDNYLVGMSSRLKAIESENGALAKYDQQTVTDVGSSDKIEVNVEGIEVIINGKTYKLEKKPV

SEQ ID NO: 2613 - protein, 409 aa, Bifidobacterium adolescentis
MNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYIRKSVLILDWEAQDNAAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGAASLPNVRPTTQPTTAPTVDLDALATRTIRGDFGNDPARRQALGGNYAAVMQIVNSRLGGGSGGTAATGSRSVVVRSGDTMSAIAARTGLQPVSAWRVPSGDVNRIYPGQTVTYGGASASTASSVVGGHVVRSGESLWSIYGSGWQSAAARNGIRSPYVIYPGQYLR

SEQ ID NO: 2614 - protein, 409 aa, Bifidobacterium adolescentis
MNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYIRKSVLILDWEAQDNAAWGDKQWPRRWAREVKRLTGVNPIIYTMDSGYWQVAGMETELNCGIWIAQYATNMVPGYQTAPWNIGARGEVMRQYTSNGSLSGWSGRLDLNKFRGDRAAWRKYANPDDKGAASLPNVRPTTQPTTAPTVDLDALATRTIRGDFGNDPARRQALGGNYAAVMQIVNSRLGGGSGGTAATGSRSVVVRSGDTMSAIAARTGLQPVSAWRVPSGDVNRIYPGQTVTYGGASASTASSVVGGHVVRSGESLWSIYGSGWQSAAARNGIRSPYVIYPGQYLR

SEQ ID NO: 2615 - protein, 409 aa, Bifidobacterium adolescentis
MNPRRQWRKLLTALAVAISMAVAPAAMADMNGYDISNWQCGIDTATVPADFVIVGTTWGSGGVYGGCLSNGVNTDANRQLAGAIDSGKETGVYHYARGGNPETEARFFVDNVRGYIRKSVLILDWEAQDNAAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGAASLPNVRPTTQPTTAPTVDLDALATRTIRGDFGNDPARRQALGGNYAAVMQIVNSRLGGGSGGTAATGSRSVVVRAGDTMSAIAARTGLQPVSAWRVPSGDVNRIYPGQTVTYGGASASTASSVVGGHVVRSGESLWSIYGSGWQSAAARNGIRSPYVIYPGQYLR

SEQ ID NO: 2616 - protein, 176 aa, unidentified
  REGION 1..176: note = Lachnospiraceae bacterium
LENLKNKLAQKNETVATNAKPAAKPAAKPAASPVAAKPAPASKVENKPAASLGRPVTTARPVSAPAPAPAAPKKTVEELAKEVIRGDWGNGQERKDKLAAAGYNYDEVQDKVNAILYGAPAATTAAPLSSTKKSIEEIAKEVIRGNWGNGQERKDKLAAAGYNYDEVQAMVNKLLK

SEQ ID NO: 2617 - protein, 184 aa, unidentified
  REGION 1..184: note = Oscillospiraceae bacterium
MADKKFNALEALKNKLTQSKTEATATAKPAATTAAKPAATPVAKPAAAPAATPTAKPAATPVTQGRPIATARPTTTTPATPKKSVEELAKEVIRGDWGNGQERKDKLAAAGYNYDEVQDKVNAILYGSSTTTATPLSATKKSVEEIAKEVIRGNWGNGQERKDKLAAAGYNYDEVQAKVNELLK

SEQ ID NO: 2618 - protein, 472 aa, Streptococcus suis
MGVNIETALRWMSDHKGRVTYSMDYRNGPNSFDCSSSVYYALMSAGAISAGWAVNTEYEHDWLVKNGYTLIAENSVFSAQRGDIFIWGKRGQSSGAGGHTGIFVDSNNIIHCNYARNGITVDNYLVTARASGNMYYYIYRPSGQSTVSTSTAGKSTDQLVKETLAGKYGNGDQRKAALGNQYQAVMAVINGKATAPKKTVDQLAQEVIQGKHGNGEDRKQSLGADYPAVQKRVTELLKKQPSEPSKSSEAKQVTESKTSQTETTEKVTVSKEDGDLSFNGAILKKAVLDKILTNCKKHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKAGGAVYDYAASGFDSYIVGASSRLKAIESENGTLSKYDTATVTDVGSKDHIDITIDGIEVIINGETYKLEKKPV

SEQ ID NO: 2619 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKVIEAENGSLTMYDTATVDNVGSTDKIEVNIEGIEISINGVTYTLSKKPV

SEQ ID NO: 2620 - protein, 423 aa, unidentified
  REGION 1..423: note = Eubacteriales bacterium
MKEQQEFIEKVAYYVKKYAKKYGILVHSPIIAQAILESGWGKSTLSSKYHNYFGMKCRTKWTGKSVNMTTQEEYQVGVQTTIKDNFRVYDSMKDGIKGYFEFIQLPRYSNLKGITDPLTYLETIKADGYATSSTYVKDNMKVIEQYDLTRFDKKEGNIMYSRKAVIKQAKAWYGCKESDGTHRKIIDVYNKQNPLPRGYRVTYRDAWCATYVSAVSLILGYTKIIPTECGCNQMIEKFKKIGCWVEDDSYVPQEADIVFYDWDDTGEGDCIGGTEHVGFVESVSGGYATIIEGNIRDSVGRRKLKINGRYIRGYAVPKYDDEPASAPEPSKPDKSVDKVAREVLEGKWGNGSERKRRLIQAGYNFDAVQKKVNWILSGKKSLEAVAKEVIAGKWGNGEARRKKLEASGYDADEVQKTVNRILS

SEQ ID NO: 2621 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTAGKSLETLVQETLAGKYGNGDTRKAALGNQYEAVMAVINGKATAPKKTVDQLAQEVIAGKHGNGEARKQSLGADYPAVQKRVTELLKKQPSEPSKSSEVKQTTETKTSQTEPTGKAIVGKEEGDLSFNGAILKKAVLEKILANCKKHDILPSYALTILHYEGLWGTSAVGKADNNWGGMTWTGQGNRPSGVTVTQGSARPSNEGGHYMHYASVDDFLTDWFYLLRSGGSYKVSGAKTFSEAVKGMFKVGGAVYDYAASGFDSYIVGASSRLKAIESENGSLAKYDQQTVTDVGSKDHIDITIDGIEVIINGETYKLEKKPV

SEQ ID NO: 2622 - protein, 242 aa, unidentified
  REGION 1..242: note = Clostridia bacterium
MAYTNSKMVSYTRLSPNHSGKRTHSIDRITPHCVVGQCSVETLGNIFAPRSRQASCNYGIGPDGRVGMYVEEKNRSWCSSSNSNDQRAVTIECASDTKHPYAMNNKVYASLIKLCTDICKRNGKKKLLWLGSKSKTLNYKPKSDEMVLTVHRWFANKSCPGDWLYSRLGDLAKKVTANLSGSSAVKKDTSSEKKNSGTKSVDQVAREVIQGKWGNGTDRKKRLTAAGYNYNAVQKRVNGLLK

SEQ ID NO: 2623 - protein, 480 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2624 - protein, 480 aa, Streptococcus suis
MTINLETSIRWMSDRVGKVTYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2625 - protein, 438 aa, Streptococcus suis
MAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2626 - protein, 480 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSTSNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAASGFDSYIVGASSRLKAIESENGSLTRFDATSNNVHSVDPDKISVDIDGIEVTINGVVYKLEKKPV

SEQ ID NO: 2627 - protein, 469 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNSITVDNYNQTAAASGWMYCYVYRMANQTSTSGKSLETLVQETLAGKYGNGDQRKAALGNQYEAVMAVINGKATAPKKTVDQLAQEVIAGKHGNGEARKQSLGADYPAVQKRVTELLKKQPSEPSKAQDVKQPAETKTSQTEPTGNTTASKEDGDLSFNGAILKKAVLEKILANCEKHDILPSYALTILHYEGLWGTSAVGKADNNWGGMTWTGQGNRPSGVTVTQGSARPSNEGGHYMHYASVDDFLTDWFYLLRKDGSYKVSGALTFSESIKGMFQVGGAKYDYAAAGYDSYLVGATSRLKAIESENGSLTRFDATSNNVHSVDPDKISVDIDGIEVTINGVVYKLEKKPV

SEQ ID NO: 2628 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTAGKSLETLVQETLAGKYGNGDTRKAALGNQYEAVMAVINGKATAPKKTVDQLAQEVIAGKHGNGEARKQSLGADYPAVQKRVTELLKKQPSEPSKSSEVKQTTETKTSQTEPTGKAIVGKEEGDLSFNGAILKKAVLEKILANCKKHDILPSYALTILHYEGLWGTSAVGKADNNWGGMTWTGQGNRPSGVTVTQGSARPSNEGGHYMHYASVDDFLTDWFYLLRSGGSYKVSGAKTFSEAIKGMFKTGGAVYDYAATGYDNYLVGMSSRLKAIEAENGSLAKYDTATVTDVGSTDKIEVNIEGIEISINGVTYTLSKKPV

SEQ ID NO: 2629 - protein, 481 aa, Streptococcus suis
MTINLETSIRWMSDRVGKVTYSMDYRNGPNSYDCSSAVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQMAQEVIQGKHGNGEDRKKSLGPDYDAVQKRVTEILQGSTSGNAPKLASDAPKNEVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIESENGSLAKYDQQTVTDVAKTDKIEVAIEGIEVTINGTRYKLTKEPI

SEQ ID NO: 2630 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTAGKSLETLVQETLAGKYGNGEQRKAALGNQYEPVMAVINGKATAPKKTVDQLAQEVIAGKHGNGEARKQSLGADYPAVQKRVTELLKKQPSEPSKAQEVKQPTETKTSQTEPTGNATVNKEEGDLSFNGAILKKAVLDKILANCKKHDILPSYALTILHYEGLWGTSAVGKADNNWGGMTWTGQGNRPSGVVVTQGLARPSNEGGQYMHYATVDDFLTDWFYLLRAGGSYKVSGAKTFSEAVKGMFKVGGAVYDYAASGFGSYIVGASSRLKAIESENGTLSKYDTATVTDVGSKDHIDITIDGIEVIINGETYKLEKKPV

SEQ ID NO: 2631 - protein, 481 aa, Streptococcus suis
MTINLETSIRWMSDRIGKVSYSMDYRNGPNSYDCSSAVYYALMAGGAISAGWAVNTEYEHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGNQYEAVMAVINGKATAPKKTVDQMAQEVIQGKHGNGEDRKKSLGPDYDAVQKRVTEILQGSTSGNAPKLASDAPKNEVVNSSTEPKTEETGATGKATDTKITKEDGDLSFNGAILKKSVLDVILAKCKEHNILPSYAITVLHFEGLWGTSAVGKADNNWGGMTWTGKGERPSGVTVTQGTARPANEGGHYMHYASVDDFLTDWFYLLRSGGSYKVSGAKTFSEAIKGMFKTGGAVYDYAATGYDNYLVGMSSRLKAIESENGSLAKYDQQTVTDVAKTDKIEVAIEGIEVTINGTRYKLTKEPI

SEQ ID NO: 2632 - protein, 469 aa, Streptococcus suis
MGVNIETALRWMSDRKGRVTYSMDYRNGPNSFDCSSSVYYALMSAGAISAGWAVNTEYEHDWLLKNGYKLIAENTDWDAKRGDIFIWGRRGQSAGAGGHTGIFIDPDNIIHCNYARNSITVDNYNQTAAASGWMYCYVYRLANQTSTAGKSLETLVQETLAGKYGNGDQRKAALGNQYEAVMAVINGKATAPKKTVDQLAQEVIAGKHGNGEARKQSLGADYPAVQKRVTELLKKQPSEPSKSSEVKQVTKTKTSQTEPTGNATVNKEEGDLSFNGAILKKAVLDKILANCKKHDILPSYALTILHYEGLWGTSAVGKADNNWGGMTWTGQGNRPSGVTVTQGTARPSNEGGHYMHYANVDDFLTDWFYLLRSGGSYKVSGAKTFSESVKGMFQVGGAKYDYAAAGYNSYLVGATSRLKAIESENGSLTRFDATSNNVHSVDPDKISVDIDGIEVTINGVVYKLEKKPV

SEQ ID NO: 2633 - protein, 409 aa, Bifidobacterium adolescentis
MNPRRQWRKLLTALTVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGAANLPSVKPKPQPTTAPTVDLDALATRTIRGDFGNDPARRQALGGNYAAVMQIVNSRLGGGSGGMAATGSRSVVVRSGDTMSAIAERTGLKPVSAWRVPSGDVNRIYPGQIVTYGGASVSIASSGVGGHVVRSGESLWSIYGSGWQSAAARNGIRSPYVIYPGQYLR

SEQ ID NO: 2634 - protein, 467 aa, Streptococcus agalactiae
MAVNIEAAIAWMSARAGKVTYSMDYRNGPGSYDCSSSVYYALMSAGAITAGWAVNTEYQHDWLIKNGYKLIAENKDWDAKRGDVFIWGRRGQSSGAGGHTGIFVDPDNIIHCNYARNGITIDNYNQTAAASGWMYCYVYRLANQSSTSTTGKSLDTLVKETLAGVYGNGDTRKAALGNQYEAVMSVINGKTTAPKKSVDQLAQEVIAGKHGNGEGRKKSLGADYPAVQKRVTEILSGNSTQEAPKQPSEPSKVEVEQLATVSKEEGDLSFNGAVLKKTVLDKILAKCKEHDILPSYAITVLHFEGLWGTSAVGKADNNWGGMTMTSDVDNITRKSGVIVTRGSARPANEGGYYMHYATVDDFLTDWFYLLRAGGSYKVSGAKTFSEAVKGMFKVGGAAYDYAASGYDNYIVGMSSRLKAIEAENGSLAKFDVATVENVGSTDKIEVNIEGIEMSINGVTYTISKKPV

SEQ ID NO: 2635 - protein, 439 aa, unidentified
  REGION 1..439: note = Clostridium sp. SY8519
MEIKGIDVSHWQGNINWAKVKAAGIKFAIIKAGGSDDGFYTDSRWEANYKGAKKNGIAVGAYYFAGPKCVTAEAGKADAKRFIQMLKGKKLEYPVYFDCEAQPASKKSGTTKAAIAFCRELEAADYYAGIYASAYSGFQDRLDDSKLGSFAHWVAQYASKCTYGGKYGIWQYSSGGKVSGISGNADMDLSYVDYPAIIRKKGLNGYPKPDADKNTGTKAEKVEAKNGKKTADAIISVMEGWLGYSEKNGKYKKIIDIYNSHKPLARGYRMKYTDAWCDAAVSAAAIKAEMTDLIGTEISCEKHVAIFKKKGIWQEDGTITPKRGDIILYNWNDHAQPNDGSSTHIGIVTKVKNGKITVIEGNHKNAVGYRTIPVGWGYIRGYARPKYDKSASAKKKSVDEIAREVIAGKWGNGNARKRKLKKAGYDYDAVQKKVNLLVK

SEQ ID NO: 2636 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKIIKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2637 - protein, 468 aa, Streptococcus suis
MIINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIAGKHGNGEARKQSLGTDYPAVQKRVTELLKKQPSEPSKGVEVKQPTDTKISQTEPPGQATESKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLTAIESENGSLAKYDQQTVTDVAKIDKIEVAIEGIEVTINGTRYRLTKEPI

SEQ ID NO: 2638 - protein, 476 aa, Streptococcus suis
MTINLETSIRWMSDRVGKVSYSMDYRNGPNSYDCSSAVYYALMAGGAISAGWAVDTEHMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILTKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTLSEAVKGMFKTGGAVYDYAASGFDSYIVGASSRLKAIEAENGSLAKYDQQTVTDVAKTDKIEVAIEGIEVTINGTRYKLTKEPI

SEQ ID NO: 2639 - protein, 468 aa, Streptococcus suis
MGVNIETALRWMSDRKGRVTYSMDYRNGPNSFDCSSSVYYALMSAGAISAGWAVNTEYEHDWLLKNGYKLIAENTDWDAKRGDIFIWGRRGQSAGAGGHTGIFIDPDNIIHCNYARNSITVDNYNQTAAASGWMYCYVYRLANQTSTAGKSLETLVQETLAGKYGNGDQRKAALGNQYEAVMAVINGKATAPKKTVDQLAQEVIAGKHGNGEARKQSLGADYPAVQKRVTELLKKQPSEPSKSSEVKQVTKTKTSQTEPTGNATVNKEEGDLSFNGAILKKAVLDKILANCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2640 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSTDKIEVNIEGIEISINGVTYTLSKKPV

SEQ ID NO: 2641 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDNYNQTAAASGWMYCYVYRLANQTSTSDKSLETLVQETLAGRYGNGDQRKAALGNQYEAVMAVINGKATAPKKTVDQLAQEVIQGKHGNGEARKQSLGADYPAVQKRVTELLKKQPSEPSKAQEVKQPTETKTSQTEPTGKAIVSKEEGDLSFNGAILKKAVLEKILANCKKHDILPSYALTILHYEGLWGTSAVGKADNNWGGMTWTGQGNRPSGVTVTQGSARPSNEGGHYMHYATVDDFLTDWFYLLRSGGSYKVSGAKTFSEAVKGMFKAGGAVYDYAANGFESYIVGASSRLKAIESENGTLSKYDTATVTDVGSKDHIDITIDGIEVIINGETYKLEKKPV

SEQ ID NO: 2642 - protein, 468 aa, Streptococcus suis
MGANIETAIRWMSDRKGRVTYSMDYRNGPNSFDCSSSVYYALMSAGAISAGWAVNTEYEHDWLLKNGYKLIAENTDWDAKRGDIFIWGRRGQSAGAGGHTGIFIDPDNIIHCNYARNSITVDNYNQTAAASGWMYCYVYRLANQTSTAGKSLETLVQETLAGKYGNGDQRKAALGNQYEAVMAVINGKATAPKKTVDQLAQEVIAGKHGNGEARKQSLGADYPAVQKRVTELLKKQPSEPSKSSEVKQVTKTKTSQTEPTGNATVNKEEGDLSFNGAILKKAVLDKILANCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2643 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWVAKRGDIFIWGRRGQSAGAGGHTGIFIDPDNIIHCNYARNGITVDNYNQTAAAIGWMYCYVYRLANQTSTAGKSLETLVQETLAGKYGNGEQRKAALGNQYEPVMAVINGKATAPKKTVDQLAQEVIAGKHGNGEARKQSLGADYPAVQKRVTELLKKQPSEPSKAQEVKQPTETKTSQTEPTGNATVNKEEGDLSFNGAILKKAVLDKILANCKKHDILPSYALTILHYEGLWGTSAVGKADNNWGGMTWTGQGNRPSGVVVTQGLARPSNEGGQYMHYATVDDFLTDWFYLLRAGGSYKVSGAKTFSEAVKGMFKVGGAVYDYAASGFGSYIVGASSRLKAIESENGTLSKYDTATVTDVGSKDHIDITIDGIEVIINGETYKLEKKPV

SEQ ID NO: 2644 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2645 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDIFIWGKRGYSSGEGGHTGIFVDNVNIIHCNFKRNGITIDDYNKVSRGMYYYLYRPANQPRTSNKSLDQLVKETLAGIHGNGDARKASLGNQYEPVMAVINGKATAPKKTVDQLAQEVIAGKHGNGEARKQSLGADYPAVQKRVTEILKGSTSGNTPKTPLDAPKSEVVNSSTEPKTEETGATGKATESKEEGDLSFNGAILKKSVLDVILAKCKEHNILPSYAITVLHFEGLWGTSAVGKTDNNWGGMTMTSNDLQITRPSGVIVTRGLARLSNEGGYYMHYATVDDFLADWFYLLRSGGSYKVSGAKTFSEAVKGMFKVGGAVYDYAATGYENYLVGMSSRLKAIEAENGSLTMYDTATVDNVGSTDKIEVNVEGIEISINGVTYTLSKKPV

SEQ ID NO: 2646 - protein, 470 aa, Streptococcus iniae
MTINTEQAIAWMSVRQGKVSYSMDYRDGPTSYDCSSSVYYALRSAGASSAGWAVNTEYMHDWLIKNGYELIAENVDWEAKRNDIAIWGERGYSSGAGGHVVMFIDADNIIHCNWARNGITIDNYNATAAASGWMYCYVYRLKGGETSSTSEKSLDTLVKETLAGTYGNGDQRKAALGNQYEAVMAVINGKATTSQKTVDELAQEVIAGKHGNGETRKKSLGNQYEAVQKRVTELLKKQSSEPSNAQEVKQPTETKTSKTEPTGKATVSKEDGDLSFNGAILKKSVLDNILANCKKHDILPSYALTILHYEGLWGTSAVGKTDNNWGGMTWTGQGQRPSGVTVTQGSARPSNEGGHYMHYASVDDFLTDWFYLLRSGGSYKVSGTKTFSEAVKGMFKTGGAVYDYAASGFDSYIVGASSRLKAIETENGSLDKFDKATDIGDGSKDKIDITIEGIEVTINGITYELTKKPV

SEQ ID NO: 2647 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILTKCKEHNILPSYAITVLHFEGLWGTSAVGKEDNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSTDKIEVNIEGIEISINGVTYTLSKKPV

SEQ ID NO: 2648 - protein, 468 aa, Streptococcus suis
MGVNIETALRWMSDHKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYARNGITVDNYNQTAAASGWMYCYVYRLANQTSTSDKSLETLVQETLAGKYGNGDQRKAALGNQYEAVMAVINGKTTAPKKTVDQLAQEVIAGKHGNGEARKQSLGADYPAVQKRVTELLKKQPSEPSKAQEVKQPTETKTSQTEPTGNATVNKEEGDLSFNGAILKKSVLDVILAKCKEHNILPSYAITVLHFEGLWGTSAVGKADNNWGGMTWTGQGNRPSGVTVTQGSARPSNEGGHYMHYTTVDDFLTDWFYLLRAGGSYKVSGAKTFSEAVKGMFKVGGAVYDYAASGFDSYIVGASSRLKAIESENGTLSKYDTATVTDVGSKDNIDITIDGIEVIINGENYKLEKKPV

SEQ ID NO: 2649 - protein, 479 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNAPKMPSDAPKSEVVNSSTEPKTEETGATGKATDTKITKEDGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLKAIESENGSLAKYDQQTVTDVGSSDKIEVNIEGIEISINGVTYTLSKNPV

SEQ ID NO: 2650 - protein, 476 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGEATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSDAVKGMFKVGGAVYDYAATGYENYLVGMSSRLKAIESENGSLAKYDQQTVTDVGSSDKIEVNIEGIEISINGVTYTLSKKPV

SEQ ID NO: 2651 - protein, 476 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKSAAPKKTVDQLAQEVIAGKHGNGEARKQSLGADYPAVQKRVTEILKGSTSGNTPKTPSDAPKSEVVNSSTEPKTEETGATGKATESKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYDNYLVGMSSRLKAIEAENGSLAKYDQQTVTDVGSSDKIEVNVDGIEISINGVTYTLSKKPV

SEQ ID NO: 2652 - protein, 476 aa, Streptococcus suis
MAINTEQAIAWMEARRGKVTYSMDYRNGPDSYDCSSAVYYALMSAGAISAGWAVDTEYMHDWLIRNGYVLVAENKPFNAQRHDVFIWGKRGYSSGEGGHAGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPLDAPKSEVVNSSTEPKTEETGATGKVTESKEEGDLSFNGAILKKSVLDVILAKCKEHNILPSYAITVLHFEGLWGISAVGKADNNWGGMTMTSNDLQITRPSGVIVTRGLARPSNEGGYYMHYASVDDFLTDWFYLLRAGGSYKVSGAKTFSDAVKGMFKVGGAVYDYAATGYENYLVGMSSRLKAIESENRSLAKYDQQTVTDVGSTDKIEVNVEGIEVIINGETYKLEKKPV

SEQ ID NO: 2653 - protein, 468 aa, Streptococcus suis
MTINLETSIRWMSDRVGKVSYSMDYRNGPNSYDCSSAVYYALMAGGAISAGWAVDTEYMHDWLIRNGYVLVAENKPFNAQRHDVFIWGKRGYSSGEGGHTGIFVDNVNIIHCNFKRNGITIDDYNKVSRGMYYYLYRPANQPSTSNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSTDKIEVNIEGIEISINGVTYTLSKKPV

SEQ ID NO: 2654 - protein, 476 aa, Streptococcus suis
MTINLETSIRWMSDRVGKVSYSMDYRNGPNSYDCSSAVYYALMAGGAISAGWAVDTEHMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILTKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTLSEAVKGMFKTGGAVYDYAASGFDSYIVGASSRLKAIEAENGSLAKYDQQTVTDVAKTDKIEVAIEGIEATINGTRYKLTKEPI

SEQ ID NO: 2655 - protein, 468 aa, Streptococcus suis
MGVNIETALRWMSDRKGRVTYSMDYRNGPNSFDCSSSVYYALMSAGAISAGWAVNTEYEHDWLIKNGYKLIAENTDWDARRGDIFVWGRRGQSAGAGGHTGIFVDPDNIIHCNYARNSITIDNYNQTAAASGWMYCYVYRLANQTSTAGKSLETLVQETLAGKYGNGDTRKAALGNQYEAVMAVINGKATAPKKTVDQLAQEVIAGKHGNGEARKQSLGADYPAVQKRVTELLKKQPSEPSKSSEVKQTTETKTSQTEPTGKAIVGKEEGDLSFNGAILKKAVLEKILANCKKHDILPSYALTILHYEGLWGTSAVGKADNNWGGMTWTGQGNRPSGVTVTQGTARPSNEGGHYMHYATVDDFLTDWFYLLRSGGSYKVSGAKTFSEAVKGMFKAGGAVYDYAASGFDSYIVGASSRLKAIESENGTLSKYDTATVTDVGSKDHIDITIDGIEVIINGETYKLEKKPV

SEQ ID NO: 2656 - protein, 468 aa, Streptococcus suis
MGVNIETALRWMSDRKGRVTYSMDYRNGPNSFDCSSSVYYALMSAGAISAGWAVNTEYEHDWLIKNGYTLIAENQDWDAKRGDVFIWGKRGQSSGAGGHTGIFIDPDNIIHCNYARNGITVNNYNQTAAASGWMYCYVYRLANQTSTSGKSLETLVQETLAGKYGNGDTRKAALGNQYEAVMAVINGKATASQKSIDELAQEVIAGKHGNGEARKQSLGNDYPEVQKRVSELLKKQPSEPSKSPEVKRATESKTSQTEPTRQATESKEEGDLSFNGAILKKVVLDKILANCKKHDILPSYALTILHYEGLWGTSAVGKADNNWGGMTWTGQGNRPSGVTVTQGSARPSNEGGHYMHYASVDDFLTDWFYLLRSGGSYKASGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2657 - protein, 479 aa, Streptococcus suis
MTIDLETSIRWMSDRVGKVSYSMDYRNGPNSYDCSSAVYYALMSAGAISAGWAVDTEYMHDWLIRNGYVLVAENKPFNAQRHDVCILGKRGYSSGAGGHVVIFVDNVNVIHCNYARNGITIDNYNQVHRGMYYYLYRPTNQPSISNKSLDQLVKETLAGVHGNGDARKASLGNQYEPVMAVINGKSAAPKKTVDQLAQEVIAGKHGNGEARKQSLGADYPAVQKRVTEILKGSTSGNTPKTPLDAPKSEVVNSSTGPKTEEIGATGKATGTKITKEDGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYDNYLVGMSSRLKAIEAENGSLAKYDTATVDNVGSTDKIEVNIEGIEISINGVTYTLSKKPV

SEQ ID NO: 2658 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILTKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSTDKIEVNIEGIEISINGVTYTLSKKPV

SEQ ID NO: 2659 - protein, 479 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGVYYYLYRPTNQPSISNKSLDQLVKETLAGVHGNGDARKASLGNQYEPVMAVINGKATAPKKTVDQLAQEVIQGKHGNGEARKQSLGADYPAVQKRVTEILKSDTSGNTPKTPSEAPKNEVVNSSTEPKTEETGATGKVTELKIVKEAGDLSFNGAILKKSVLDVILAKCKEHNILPSYAITVLHFEGLWGTSAVGKADNNWGGMTMISNDLQITRPSGVIVTRGLARPSNEGGYYMHYASVDDFLTDWFYLLRAGGSYKVSGAKTFSDAVKGMFKVGGAVYDYAATGYDNYLVGMSSRLKAIEAENGSLAKYDQQTVTDVAKIDKIEVAIEGIEVTINGTRYRLTKEPI

SEQ ID NO: 2660 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATADNVGSTDKIEVNIEGIEISINGVTYTLSKKPV

SEQ ID NO: 2661 - protein, 468 aa, Streptococcus suis
MTINIETAIRWMTDRVGRVTYSMDFRNGPNSFDCSSSVYYALMSAGAISAGWAVNTEYEHDWLVKNGYTLIAENTDWDAKRGDIFIWGRRGQSAGAGGHTGIFVDPDNIIHCNYARNGITVDNYNQTAAASGWMYCYVYRLANQTSTSGKSLETLVKETLAGVYGNGDTRKVALGNQYEAVMAVINGKATAPKKTVDQLAQEVIVGKHGNGEARKQSLGADYPAVQKRVTELLKKQPSEPSKAQEVKQPTENKTSQTEPTGNATVNKEEGDLSFNGAVLNKDVLDKILDNCKKHDILPSYALTILHYEGLWGTSAVGKADNNWGGMTWTGQGNRPSGVTVTQGSARPSNEGGHYMHYASVDDFLTDWFYLLRADGSYKVSGAKTFSEAVKGMFKVGGAVYDYAASGFDSYIVGASSRLKAIESENGTLSKYDTATVTDIGSKDHIDITIDGIEVIINGETYKLEKKPV

SEQ ID NO: 2662 - protein, 471 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFVDPDNIIHCNYARNGITVDNYNQTAAASGWMYCYVYRLANQPTTSPSGKTLDTLVKETLAGKYGNGDTRKAALGNQYEAVMAVINGKASANQKSVDELAQEVIQGKHGNGEARKQSLGADYLAVQKRVTELLKKQPSEPSNAQEVKQPTETKTSQTEPTGNATVNKEEGDLSFNGAILKKAVLDKILANCKNHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIIGASSRLKAIESENGSLTRFDATSNNVHSVDPDKISVDIDGIEVTINGVVYKLEKKPV

SEQ ID NO: 2663 - protein, 476 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPVNQPSISNKSLDQLVKETLAGVHGNGDARKASLGNQYEPVMAVINGKATAPKKTIDELVQEVIAGKHGNGEARKQSLGADYPAVQKRVTEILKGSTSGNTPKTPSDAPKSEVVNSSTEPKTGETGATGKATESKEEGDLSFNGAILKKSVLDVILAKCKEHNILPSYAITVLHFEGLWGTSAVGKADNNWGGMTMTSNDLQITRPLGVIVTRGLARPSNEGGYYMHYASVDDFLTDWFYLLRAGGSYKVSGAKTFSEAVKGMFKVGGAVYDYAATGYDNYLVGMSSRLKAIEAENGSLAKYDTATVDNVGSTDKIEVNIEGIEISINGVTYTLSKKPV

SEQ ID NO: 2664 - protein, 270 aa, Arcanobacterium phocae
MKNWEKVEADLDLILDKHFTVGRDGHKIDKIILHHNAGNLDAQGIYGTWQNRRASAHYQVDAEGTISQHVWDQHTAWSVLKWHANCTSLSIEHANNDFTVWTIWDKTLEEGAHLTAALCKFYGLGRPQWKKNVFGHNFFSPTACPGAIAGTQLGKYMERAQYWYDTMTGTTAPAPAPIPITIPEKTISQLADEVMAGVYGNGDARRNALGSKYEAVQAEINRRILGDPNRISNLADRAMAGEFGNGDQRRAALGGDYAAVQAEINRRYGI

SEQ ID NO: 2665 - protein, 479 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPV

SEQ ID NO: 2666 - protein, 307 aa, Ruminococcus callidus
MAILKPDNKTTFGGVTVNEYLLTKHNPNHIAMPSVSMEGKIIGVTVHNTAWITTVAGTTPAEQYTRATANGNMNDVRVHYYVDNTCAWQNLPHSLSGWHAADGSGNGNRRTIAIECIMSSAYNATDKKSEDNCARLAAALLKKYNLGIDHLYTHTHWLNVRDGKSGSVDYLNTARNSYKMCPLYILPHWAEFKKKVQGYMNAGSATAPTPSAPAAKQLYRVRKSWFDAKSQIGAFSSLENARRACKVGYAVFDSSGKQVYPVKKSIDEIAHEVIQGKWGNGAERKKRLTNAGYGYNEVQKRVNALMK

SEQ ID NO: 2667 - protein, 422 aa, Bifidobacterium adolescentis
MNILNKGKPKHKRMNPRRQWRKLLTALAVAISMAFAPAAMADMDGYDISNWQCGIDTATVPADFVIVGTTWGSGGVYGGCLSNGVNTDANRQLAGAINSGKETGVYHYARGGNPETEAKFFVDNVRGYVHRSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRTAWRKYANPEDKGTASLPNVKPTPQPTTAPTVDLDALATRTIRGDFGNDPARRQALGGNYAAVMQIVNSRLGGGSGGTAATGSRSVVVRSGDTMCAIAERTGLKPVSAWRVPSGDVNRIYPGQIVTYGGASVSIASSGVGGHVVRSGESLWSIYGSGWQSAAARNGIRSPYVIYPGQYLR

SEQ ID NO: 2668 - protein, 470 aa, Streptococcus suis
MGVNIETALRWMSDRKGRVTYSMDYRNGPNSFDCSSSVYFALMSAGAISAGWAVNTEYEHDWLIKNGYTLIAENTDWDAKRGDIFIWGRRGQSAGAGGHTGIFVDPDNIIHCNYARNGITVDNYNQTAAASGWMYCYVYRLANQPTTSPSGKTLDALVKETLAGKYGNGDTRKAALGNQYEAVMAVINGKASANQKSVDELAQEVIQGKHGNGEVRKKSLGSQYEVVQKRVSELLKKQPSESLKGPEVKQATESKTSQTEPTEQATESKEEGDLSFNGVILKKAVLDKILANCKKHDILPSYALTILHYEGLWGTSAVGKTDNNWGGMTWTGQGNRPSGVTVTQGSARPSNEGGHYMHYASVDDFLTDWFYLLRAGGSYKVSGSKTFSEAVKGMFKVGGAVYDYAASGFDSYIVGASSRLKAIESENGTLSKYDTATVTDVGSKDHIDITVDGIEVIINGETYKLEKKPV

SEQ ID NO: 2669 - protein, 468 aa, Streptococcus suis
MGVNIETALRWMSDRKGRVTYSMDYRNGPNSFDCSSSVYYALMSAGAISAGWAVNTEYEHDWLIKNGYTLIAENTDWDAKRGDIFIWGRRGQSAGAGGHTGIFIDPDNIIHCNYARNGITVDNYNQTAAASGWMYCYVYRLANQTSTSGKSLETLVQETLAGKYGNGDQRKAALGNQYEAVMAVINGKATASKKSIDELAQEVIQGKHGNGEVRKQSLGDDYPEVQKRVSELLKKQPSEPSKTQEVKQATESKTSQTEPTGQATESKEEGDLSFNGAILKKAVLDKILANCKKHDILPSYALTILHYEGLWGTSAVGKVDNNWGGMTWTGQGNRPSGVTVTQGSARPSNEGGHYMHYASVDDFLTDWFYLLRDGGSYKVSGAKTFSEAVKGMFKVGGAVYDYAASGFDSYIVGASSRLKAIEKENGSFAKYDTAIVTDVNQSDDIEINVEGIEVIINGETYMLEKKPV

SEQ ID NO: 2670 - protein, 404 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMF

SEQ ID NO: 2671 - protein, 468 aa, Streptococcus suis
MGVNIETALRWMSDRKGRVTYSMDYRNGPNSFDCSSSVYYALMSAGAISAGWAVNTEYEHDWLVKNGYTLIAENTDWDAKRGDIFIWGRRGQSAGAGGHTGIFIDPDNIIHCNYARNSITVDNYNQTAAASGWMYCYVYRLANQTSTSGKSLETLVQETLAGKYGNGDQRKAALGNQYEAVMAVINGKATAPKKTVDQLAQEVIAGKHGNGEARKQSLGADYPAVQKRVTELLKKQPSEPSKSSEVKQVTKNKTSQTEPTGNATVNKEEGDLSFNGAILKKAVLDKILANCKKHDILPSYALTILHYEGLWGTSAVGKADNNWGGMTWTGQGNRPSGVTVTQGTARPSNEGGHYMHYANVDDFLTDWFYLLRAGGSYKVSGAKTFSEAVKGMFKVGGAVYDYAASGFDSYIVGASSRLKAIESENGSLDKFDKQTVTDVGQSDDIEINVEGIEVIINGETYKLEKKPV

SEQ ID NO: 2672 - protein, 422 aa, Bifidobacterium adolescentis
MNILNKGKPKHKRMNPRRQWRKLLTALTVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGAANLPSVKPKPQPTTAPTVDLDALATRTIRGDFGNDPARRQALGGNYAAVMQIVNSRLGGGSGGMAATGSRSVVVRSGDTMSAIAERTGLKPVSAWRVPSGDVNRIYPGQIVTYGGASVSIASSGVGGHVVRSGESLWSIYGSGWQSAAARNGIRSPYVIYPGQYLR

SEQ ID NO: 2673 - protein, 422 aa, Bifidobacterium adolescentis
MNILNKGKPKHKRMNPRRQWRKLLTALAVAISMAVAPAAMADMNGYDISNWQCGIDTATVPADFVIVGTTWGSGGVYGGCLSNGINTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRAAWRKYANPDDKGTASLPNVKPTPQPTTAPTVDLDALATRTIRGDFGNDPARRQALGGNYAAVMQIVNSRLGGGSGGTAATGSRSVVVRSGDTMCAIAERTGLKPVSAWRVPSGDVNRIYPGQIVTYGGASVSIASSGVGGHVVRSGESLWSIYGSGWQSAAARNGIRSPYVIYPGQYLR

SEQ ID NO: 2674 - protein, 422 aa, Bifidobacterium adolescentis
MNILNKGKPKHKRMNPRRQWRKLLTALTVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNLVTGYQTAPWNIGARGEVMRQYTSNGSLSGWSGRLDLNKFRGDRTAWRKYANPDDKGAANLPSVKPKPQPTTAPTVDLDALATRTIRGDFGNDPARRQALGGNYAAVMQIVNSRLGGGSGGMAATGSRSVVVRSGDTMSAIAERTGLKPVSAWRVPSGDVNRIYPGQIVTYGGASVSIASSGVGGHVVRSGESLWSIYGSGWQSAAARNGIRSPYVIYPGQYLR

SEQ ID NO: 2675 - protein, 422 aa, Bifidobacterium adolescentis
MNILNKGKPKHKRMNPRRQWRKLLTALAVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGAASLPNVRPTTQPTTAPKVDLDALATRTIRGDFGNDPARRQALGGNYAAVMQIVNSRLGGGSGGTAATGSRSVVVRSGDTMSAIAARTGLQPVSAWRVPSGDVNRIYPGQIVTYGGASASTASSVVGGHVVRSGESLWSIYGSGWQSAAARNGIRSPYVIYPGQYLR

SEQ ID NO: 2676 - protein, 351 aa, unidentified
  REGION 1..351: note = Bacteroides caecimuris
MSLQHSAKGSTWKDHKYIKRVNGTYFYPKGYKGGHQSENTSGKELEDWEKTMYEDIEATLKKNPGLFDPSQITDDNWQDFGVTLAEFAGVDTDKLSKEEIERMRQKVADHYAQKEPESKLDKEDVEALANEVIRGNFGNGTVRKDLLGEDYSEVQKKVNEILKKNKPLTSAKTGTKAADVKHSELYHHGVLGQRWGVRRYQNSDGTLMSAGRRRLQGSGISSDENGRVSGDNSGRARGAVHQTVANDYKNAGAGLQSASNAAKAASSISSRGANRKQAKAMDKMDLSKMTDKELQAAINRLNLERNYKSLSTAHIKSGRDYVSSFLSTTGDVLAIGASAASIMMMIHQLKS

SEQ ID NO: 2677 - protein, 307 aa, unidentified
  REGION 1..307: note = uncultured Ruminococcus sp.
MAILKPDNKTTFGGVTVNEYLLTKHNPNHIAMPSVSMEGKIIGVTVHNTAWITTVAGTTPAEQYTRATANGNMNDVRVHYYVDNTCAWQNLPHSLSGWHAADGSGNGNRRTIAIECIMSSAYNATDKKSEDNCARLAAALLKKYNLGIDHLYTHTHWLNVRDGKSGSVDYLNTARNSYKMCPLYILPHWAEFKKKVQGYMNAGSATAPTPSAPAAKQLYRVRKSWFDAKSQIGAFSSLENARRACKVGYAVFDSSGKQVYPVKKSIDEIAHEVIQGKWGNGAERKKRLTNAGYDYNEVQKRVNALMK

SEQ ID NO: 2678 - protein, 330 aa, unidentified
  REGION 1..330: note = Megamonas hypermegale
MAKSGLATVSIPASTTNYTKGRTSKISTITVHHMAGVLTVEQCGNVFKNANRGASAHYGIGNDGRIGSYVDENDTAWSDANWPSNCRTVSIETSNSSTGGNWPVSDAAFDSLCKLVADIAKRNNLGTLEPGKNLVWHSMFAKTTCPGDYLRSKMDEIARRANEINGQAATTPSTGGGKKSNDEIANEVIAGKWGNGDDRKQRLQNAGYDYNAIQSLVNQKLGGGAATAPAKKSNEQVADEVIAGQWGNGDDRKKRLQEAGYDYNAVQAIVNQKLGGGGGGSSTVYYSVRYGDTLSEIAQRYGTTTAKLAKDNGISNPNLIYAGQRLVINK

SEQ ID NO: 2679 - protein, 351 aa, unidentified
  REGION 1..351: note = uncultured Bacteroides sp.
MSLQHSAKGSTWKDHKYIKRVNGTYFYPKGYKGGHQSENTSGKELEDWEKTMYEDIEATLKKNPGLFDPSQITDDNWQDFGVTLAEFAGVDTDKLSKEEIERMRQKVADHYAQKEPESKLDKEDVEALANEVIRGNFGNGTVRKDLLGEDYSEVQKKVNEILKKNKPLTSAKTGTKAADVKHSELYHHGVLGQRWGVRRYQNSDGTLTSAGRRRLQGSGISSDENGRVSGDNSGRARGAVHQTVANDYKNAGAGLQSASNAAKAASSISSRGANRKQAKAMDKMDLSKMTDKELQAAINRLNLERNYKSLSTEHIKSGRDYVSSFLSTTGDVLAIGASAASIMMMIHQLKS

SEQ ID NO: 2680 - protein, 468 aa, Streptococcus suis
MGVNIETALRWMSDHKGRVTYSMDYRNGPNSFDCSSSVYYALMSAGAISAGWAVNTEYEHDWLIKNGYKLIAENTDWDAKRGDIFIWGRRGQSAGAGGHTGIFIDPDNIIHCNYASNGIMVDNYNQTAAASGWMYCYVYRLANQTSTAGKSLETLVQETLAGKYGNGEQRKAALGNQYEPVMAVINGKATAPKKTVDQLAQEVIAGKHGNGEARKQSLGADYPAVQKRVTELLKKQPSEPSKAQEVKQPTETKTSQTEPTGNATVNKEEGDLSFNGAILKKAVLDKILANCKKHDILPSYALTILHYEGLWGTSAVGKADNNWGGMTWTGQGNRPSGVVVTQGLARPSNEGGQYMHYATVDDFLTDWFYLLRAGGSYKVSGAKTFSEAVKGMFKVGGAVYDYAASGFDSYIVGASSRLKAIESENGTLSKYDTATVTDVGSKDHIDITIDGIEVIINGETYKLEKKPV

SEQ ID NO: 2681 - protein, 476 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTEILKGSTSGNTPKTPSDAPKSEVVNSSTEPKTEETGATGKATESKEAGDLSFNGAILKKSVLDVILTKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKAIEAENGSLTMYDTATVDNVGSSDKIEVNIEGIEISINGVTYTLSKKPV

SEQ ID NO: 2682 - protein, 434 aa, unidentified
  REGION 1..434: note = Streptococcus orisratti
SSAVYYALMAGGAISAGWAVNTEYMHDWLIRNGYVLVAENKPFNAQRHDVCIFGKCGYSSGADGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGADYPAVQKRVTELLKKQSSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKTGGAVYDYAATGYDNYLVGMSSRLKVIEAENGSLTMYDTATVDNVGSTDKIEVNIEGIEISINGVTYTLSKKPV

SEQ ID NO: 2683 - protein, 349 aa, Streptococcus suis
EYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTVDQLAQEVIAGKHGNGEARKQSLGTDYPAVQKRVTELLKKQPSEPSKGVEVKQPTDTKISQTEPPGQATESKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAAT

SEQ ID NO: 2684 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGVTIDDYNKVSRGMYYYLYRPTNQPSISNKSLDQLVKETLAGVHGNGDARKASLGNQYEPVMAVINGKATAPKKTVDQLAQEVIAGKHGNGEARKQSLGADYPAVQKRVTELLKKQPSEPSKGVEVKQPTETKISQTEPPGQATVSKEEGDLSFNGAILKKSVLDVILAKCKEHNILPSYAITVLHFEGLWGTSAVGKADNNWGGMTMTSNDLQITRPSGVIVTRGLARPSNEGGYYMHYATVDDFLTDWFYLLRAGGSYKVSGAKTFLEAVKGMFKVGGAVYDYAATGYENYLVGMSSRLTAIESENGSLAKYDQQTVTDVAKIDKIEVAIEGIEVTINGTRYRLTKEPI

SEQ ID NO: 2685 - protein, 479 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGVYYYLYRPTNQPSISNKSLDQLVKETLAGVHGNGDARKASLGNQYEPVMAVINGKATAPKKTVDQLAQEVIQGKHGNGEARKQSLGADYPAVQKRVTEILKSDTSGNTPKTPSEAPKNEVVNSSTEPKTEETGATGKVTELKIVKEAGDLSFNGAILKKSVLDVILAKCKEHNILPSYAITVLHFEGLWGTSAVGKADNNWGGMTMISNDLQITRPSGVIVTRGLARPSNEGGYYMHYASVDDFLTDWFYLLRAGGSYKVSGAKTFSDAVKGMFKVGGAVYDYAATGYDNYLVGMSSRLKAIESENGALAKYDQQTVTDVGSSDKIEVNVEGIEVIINGKTYKLEKKPV

SEQ ID NO: 2686 - protein, 468 aa, Streptococcus suis
MTINLETSIRWMSDRIGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDQLAQEVIAGKHGNGEARKQSLGTDYPAVQKRVTELLKKQPSEPSKGVEVKQPTDTKISQTEPPGQATESKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAATGYENYLVGMSSRLTAIESENGSLAKYDQQTVTDVAKIDKIEVAIEGIEVTINGTRYRLTKEPI

SEQ ID NO: 2687 - protein, 468 aa, Streptococcus suis
MTINLETSIRWMSDRIGKVSYSMDYRNGPNSYDCSSAVYYALMSAGAISAGWAVNTEYMHDWLIRNGYVLVAENKPFNAQRHDVCILGKRGYSSGAGGHVVIFVDNVNVIHCNYARNGIAIDNYNQVHRGMYYYLYRPTNQPSISNKSLDQLVKETLAGLHGNGDARKASLGNQYEAVMAVINGKATAPKKTVDQLAQEVIAGKHGNGEARKQSLGADYPAVQKRVTELLKKQPSEPSKSVEVKQPTETKISQTEPPGQATVSKEEGDLSFNGAILKKSVLDVILAKCKEHNILPSYAITVLHFEGLWGTSAVGKADNNWGGMTMTSNDLQITRPSGVIVTRGLARPSNEGGYYMHYATVDDFLADWFYLLRSGGSYKVSGAKTFSEAVKGMFKVGGAVYDYAATGYDNYLVGMSSRLKAIEAENGALAKYDQQTVTDVGSIDKIEVNIDGIEISINGVTYTLSKKPV

SEQ ID NO: 2688 - protein, 422 aa, Bifidobacterium adolescentis
MNILNKGKPKHKRMNPRRQWRKLLTALAVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLILDWEAQDNAAWGDKQWPRRWAREVKRLTGVNPIIYTMDSGYWQVAGMETELNCGIWIAQYATNMVTGYQTAPWNIGARGEVMRQYTSNGSLSGWSGRLDLNKFRGDRAAWRKYANPDDKGAASLPNVRPTTQPTTAPKVDLDALATRTIRGDFGNDPARRQALGGNYAAVMQIVNSRLGGGSGGTASTGSRSVVVRSGDTMSAIAARTGLQPVSAWRVPSGDVNRIYPGQIVTYGGASASTASSVVGGHVVRSGESLWSIYGSGWQSAAARNGIRSPYVIYPGQYLR

SEQ ID NO: 2689 - protein, 291 aa, unidentified
  REGION 1..291: note = Siphoviridae sp. ct1SN28
MAISPLATEKYAAHPSNYTAGRPQGAPDHITVHHMAGVLSAAQCGAVFQRPGRGGSAHYGIGNGGEIANYVDENDTAWSDSNWNSNCKTISIETANSENGGEWPVGEAAFNSLVKLVADIAKRNGLGHLVPGVNLCWHSMYAQTTCPGNHLRGRMHELAERANAINEAASAPAPAPQPNKSNETIADEVIRGDWGNGEDRKARLAAAGYDYAAVQAIVNQKLAPQPAPEPAPEPFKVGDTVVPTRLVDYNGTPLVQYDPTYTIAELNGNRAVLTARGAVWAAMRTEDIRRA

SEQ ID NO: 2690 - protein, 317 aa, unidentified
  REGION 1..317: note = Caudoviricetes sp.
MVMRGIDISKWQSGIDLSAVNADFVIVKATEGIGYVDKSCDGFFQKALDLGKKLGFYHFARPTNDPVREADFFYNSCRGYFGKGIPILDWESGNTSNVAWAKRWLDRVYQLSGVKPVIYMSESVVNANDWSSVANADYGLWVAKYRDNSPDYNYNMANAGSRPHVKWWKFYCMWQWTSSGRLNGYNGNLDCDVFYGDGSTWDAYVGKPASSAKPQSKPVAKTTDQLADEVIAGQWGNGSDRKKRLTAAGYDYNAVQKAVNQKMAAKKQTAHVYYVVKRGDTLSGIAAKYGTTYQRLAQINGIVNPNRIYAGQKIRVK

SEQ ID NO: 2691 - protein, 346 aa, unidentified
  REGION 1..346: note = Caudoviricetes sp.
MYGIDISKHNGNINLEQYKGQFVIIRVGYGNFHLDEKFERNVNECKRLGIPFGVYHYSYALNEAEAEAEARGVLNAIAKYKNDIKVGVWFDMEDADGYKKKHGFKFSNGTIAPICYKFCKIIEDAGYYSGIYTSSSWLDYVKGLNDRFDKWVANWGKNDGTQHTNTSQYGTLQQYTSKPLDKNVMYADLSRYSRGNTTQPQPKPIYQIADEVIAGQWGNGDDRKKRLTDAGYDYNAVQDIVNKKVAPMRKSNDQIASEVIAGQWGDGNDRKNRLEQAGYNYDAVQKAVNKKMGAKKQPAHVYYVVKRGDTLSGIASKYGTTWQKLQAMNGIANPNKIYTGQCLRVK

SEQ ID NO: 2692 - protein, 124 aa, unidentified
  REGION 1..124: note = Oscillospiraceae bacterium
DAIAEEVIAGKWGNGAERKKKLKAAGYDYDAIQQLVNQKLSPKKETSKPKKETPKPAPKPAAKPAKIKVGDMISYTGRLYLTSYGILPGKKVSGKFKVDRVIEGRKYGIHIPGGWIEASKAKRK

SEQ ID NO: 2693 - protein, 385 aa, unidentified
  REGION 1..385: note = Mediterraneibacter gnavus
MKKEEFIQKIAGYVKKYAAAYEIKVCSPIIAQAILESGWGESRLVKDYHNYFGLKCGTKWQGKSVNLATWEEYEAGTATVISDYFRVFDNMEEGVKGYFELLQLPRYQNLKGITEPGRYLETIWADGYATSSVYVQKNMELIEQYQLTKYDENVSGRRAQDVLNVMRSWIGYSEANGKFRQIIDLYNSHQPLARGYAVQYTDEWCDTAVSAAAIQAGCVDLIGTECGCEKHIEIFKEKGIWIEDGTIVPLLGDIILYNWDCQAQPNDGYSDHIGYVESVSGQMITVMEGNYNEAVAGEVIQGKYANGEERRKKLCDMGYDPDAVQREVNRQLSQNEAPAEYYVVQENDTLSEIAKRFATTYLELAAWNGIADPNMIYVGQKIRIR

SEQ ID NO: 2694 - protein, 218 aa, unidentified
  REGION 1..218: note = Lactococcus carnosus
MKKITCMATLALILLGTAGVATSAHADELADKAQQVIKGDFGNGQDRKENLGTDYDLVQSKVNELLGLASVLPVAPTDSLVASAVVSQGNFSTASVSAQTQYSHKENGHNEGQYYTISSSGAMITKTDTGSIVSGDVSRIRSIGLEKKSIVLNYVLNFDASGNYVSGSVSSSGYVSAMINLVPGQNYTGQSVNFISTTSGVALSGSYIYPITASLNLN

SEQ ID NO: 2695 - protein, 83 aa, unidentified
  REGION 1..83: note = Clostridia bacterium
GAFIPKQVQEEFNRKMEEAKENELKSVEPEVDILTLVKRTIRGDFGNGEERKQHLGQYYDEVRRQVNLNYQHGTTNWDNIRLY

SEQ ID NO: 2696 - protein, 225 aa, unidentified
  REGION 1..225: note = Prevotellamassilia timonensis
MTEDKSKRKSTRKFNLEKHVKRSFNLEKEVAATPAPSAEAPATPQPAPTPVPAGGGDATHTGNGGNKGKHVLSLVVGLAVVAAIGFAAFRGCNSNSSQPVDEPVVDTVMDEQPTAPTDSTQRADSTQLGGGDQNAPAGAPNEVQPQDDAVNAATPSAQPETSTPSTPSTPSTTKTATPSTDVDAEVQKVLHGDYGNGQERKDKLGSSYSKIQRAVNRYYRSKGLL

SEQ ID NO: 2697 - protein, 207 aa, unidentified
  REGION 1..207: note = Thiotrichales bacterium
MIKEAAKYLGANTATRQELINHYNQFCLPQVKKERRYKMGLGDNWCAMFVTTIANKCGASAEQFPYEVSVFYQTQIAKERELFTKEFSIVQENDLIIYDWEGHGVLSHVGFVAEIYGKNIVALEGNIKNTVGYRTISSESRFIAGFIKNPYARQQAASEVQLTDLDRVQGLARRTLRGEFGNGLERAYRLGADYAAVQKLINSGWSE

SEQ ID NO: 2698 - protein, 225 aa, unidentified
  REGION 1..225: note = Prevotellamassilia timonensis
MTEDKSKRKSTRKFNLEKHVKRSFNLEKEGAATPAPSAEAPATPQPAPTPAPAGGGDATQTGNGGNKGKHVLSLVAGLAVVAAIGFAAFRGCNSNSSQPVDEPVVDTVMDEQPTAPTDSTQRADSTQLGGGDQNAPAGAPNEVQPQDETVNAATPSAQPETSTPSTTSTPSTTKTATPSTDMDAEVQKVLHGDYGNGQERKDKLGSSYSKIQRAVNRYYRSKGLL

SEQ ID NO: 2699 - protein, 395 aa, Streptococcus agalactiae
MTVDTEKAIVWMQNKKGCVSYSMDYRNGPNSYDCSSSVCSALIYAGASNPGWLLNTEYMHDWLVQNGYQLISENDGWDSQRGDIFIWGQRGASAGAGGHTGMFVDADNIIHCNYANNNITINNYNETAAASGWMYSYAYRYTGSQSQPTNKSIDELAKEVLAGQHGSGEQRKLSLGTNYDAVQAKVAEQSPVVKQDGDLLFNGAVLKKSVLDKILAKCKEHDILPSYAITVLHFEGIWGQSAVGRSDNNWGGMTWTGQGNRPSGITVTQGTARPSKEGGNYMHYASVDDFLTDWFYLLRQGGSYKVSGAKTFSEAIKGMFKAGGAVYDYAATGYDNYLVGMSSRLKAIEAENGSLAKYDVGTVDNVGSTDKIEVNIEGIEISINGVTYTISKKPV

SEQ ID NO: 2700 - protein, 367 aa, unidentified
  REGION 1..367: note = Arthrobacter phage Tokki
MVLPITGINEQFNAAFFTEGPTQKDGIVIHWWGLPQGQTIQSVRDTFAGGGRQASAHYGCSDGVVDCYVNPDDVAWANGHWGANLSKISIECDPRQSDGDYYAAAWTVAYIRSIYGDLPLSRHDNYYATQCCGTYDINRIDRLARTIDVKSVSKPTPAKPAPAKPAVPATKGKTIAQLAEEVLKGAYGTGDARRLALGAQFQAVQDEVNRRLSGAANPKPKPNISALADQVLAGKFGNGDQRITALGANYQAVQDEVNRRANAKPASKPAAKPAPKPAAKPVATVVNISDLVRRTLNGEFGNGDERKRRLGANYQAVQNAINAGAQPNINDLVARTLRGDFGDGDERKRRLGSNYSAVQAEINRRYS

SEQ ID NO: 2701 - protein, 476 aa, Streptococcus suis
MALNMEQAIAWMEARRGKVTYSMDYRNGPNSYDCSSSVYFALMSAGAISAGWAVNTEYEHDWLIKNGFKLISENGVFAAQRGDIFIWGRRGQSSGAGGHTGIFVDSNNIIHCNWARNGITVDGYLATARAAGNMYYYIYRPSGQAQVSSSTAGKSIDQLVQETLAGKYGNGEQRKAALGPQYQAVMERINGKASAVEKSDEELAREVLAGKHGNGEDRKRSLGSRYPAVQKKVDELLKKPASPQPAPKVETPKVETLKVEQPKVEVPKTEAPVFAEDGDLKFNGAILKKEVLNKILAKCKEHDILPSYALTILHYEGLWGTSAVGKADNNWGGMTWTGKEERPSGVTVTQGTARPASEEGKYMHYATVDDFLTDWFYLLRSGGSYKVSGAKTFSEAVKGMFKVGGAVYDYAATGYDNYLVGMSSRLKAIEQENGSLAKYDTATVTDVGSTDKIEVNIEGIEISINGVIYELTKKPV

SEQ ID NO: 2702 - protein, 409 aa, unidentified
  REGION 1..409: note = Ruminiclostridium sp.
MSDRSLARRTKSKVIFDGADISKDLEQYLLSITYEDHDEDDADTLEIRVQDRDEVWSSKWLNAMWEAGKGMSIQAVISACNWNSNGGDAVLDCGAFELDSVSMQGPPSTIAIRGTSAPYNCTLQQTQHSKSWESYDLKKIAGEIASNAGMAVQYLPKPVPSYARVEQYRCSDIMFLKKLCQDAGFSVKVCNKIIVIFDQKEYETKGPVRTFSKSSGKIIKYKLYTNETQTYALCHVYYDNDGTLIEWTQKAEDYDPKNNSNQKLEIQQKVSTVEEAKALAKEMLRLYNKFAFEAEFTVPGDPALVAGATFAVSGFGKFDGTYLIKTATHKASGGSSGYTTTVKGQKALSSEQSDNSSSSSEMSQEQIDQLATEVIRGDWGAGQERKDKMAAAGYDYQTVQDRVNELIYG

SEQ ID NO: 2703 - protein, 191 aa, unidentified
  REGION 1..191: note = Clostridia bacterium
MVWQKGSTLLGKDGAGHVAIVEKIYNSNEIYTSESGYNSKAFWNSKRNNNNGKWGVGSGYKFRGCIVNPAVGKVTAATTSTKKSVETLAKEVIDGKWGNGSDRKKRLTNAGYNYSEVQKRVNELVSSTKKTTSTKKTTSTKTTSVTYTVKKGDTLIKIAKKYGTTYQKIAKDNKISNPNLIHVGQKLVIKK

SEQ ID NO: 2704 - protein, 362 aa, unidentified
  REGION 1..362: note = Erysipelotrichaceae bacterium
MTFNGIDISNWQRGIDLSKVPCDFVIAKATEGIGYVDKSCDGFIQQAFKLGKKIGFYHFARPTANNDPIREADFFYENCKGYFGKAIPILDWEAENKHNVAWAKKWLDRVYQRSGVKPVIYMSESVVNSYDWSSVANADYGLWVAKYRDNNADYNYNMANAGRRPRVKWWKFYCMWQWTSSGRLNGYNGNLDCNVFYGDGSTWDAYAGKKSSGTKPKPTPQKKSVEQLAREVLQGLWGNGGERKNRLTSAGYDYNAVQKRVNEMCGAKKSNYEIAREVIAGKWGNGDDRKQRLTSAGYNYTVIQAIVNKLMGDNKAVYYTVRSGDTLSDIASRYGTTYQHLAQINGIADPNRIYPGQKIRVK

SEQ ID NO: 2705 - protein, 264 aa, unidentified
  REGION 1..264: note = Aerococcaceae bacterium NML210727
MIKKPQRINKSLLHAGRMPSIKGVVLHNDAGSRNATATWYMNSFLPNHNLELGIAHYYIDVDVIGRAIDTYNQAWHTASAEGNNHYIGYEACQSKGDEARFRANEDMMLRQAAEDMLFYKIPVTRQTVRLHQEFSSTTCPHRSMELHGKSVNAVKDYFIARIMHYQTLGKTVDEMIDAENRGAIKAQPKPALKPIDEVAREVLAGRWGNGQERKNKLTQAGYNYDEVQKRVGELKVVPKKEAPTVKPDDLEFTVEGQTFIVTKK

SEQ ID NO: 2706 - protein, 490 aa, unidentified
  REGION 1..490: note = Clostridiaceae bacterium
MATKGIDVSVWQGAIDFNAVRNSGVDFVIIRAGSGTSSKDKYFEENYRKAKAAGLHVGAYWYSYADSFSEAAQEAEMFLAVLAGKQFDYPVFFDMEEKKQIEAGTDFCSGLIKTFCDRLEAAGYFAGFYTSASFAGSVVTDAVRKRYCYWCAQWADGCSYEDSCGIWQHSSNGSVPGINGRVDMDWSYQDFPSVIIGKGFNGYPRTGNETPVPAVTIPVSSQRDRVLAQARAWIGRNESDGSHREIIDVYNNHKHLARGYAVQYTDAWCATFVSAVSIQCGTTSIIPTECGCGQMLILFMVLGEWVEDDNYVPAPGDVIFYDWQDSGCGDNEGWPDHVGIVESVSSSDITVIEGNKNDAVGRRTLQVGGKYIRGYGVPKYAIDSSETPVSSKTVDELAQEVLAGNWGNGEERKNRLSAAGYDYDSVQTKVNELCGVHNEPHPVYYTVKSGDTLSAIAHQYGTTVSAIQSMNSSLIQNVNLILVGWKIRVK

SEQ ID NO: 2707 - protein, 68 aa, unidentified
  REGION 1..68: note = Granulicatella sp. zg-ZJ
MSDFLLSKDYLLEMNWLVETVIPSLKSIDVVAREVINGHWGNGQERKNRLTQAEYDYDHVQQRVNKIE

SEQ ID NO: 2708 - protein, 214 aa, unidentified
  REGION 1..214: note = Granulicatella sp. 19428wC4_WM01
MCVGICQRNGIQALNYTGDTSGNMTKHEWFANTNCLGHYLGSKFPYIASEVNKRLSGQSSPPVQQTHTNLDDVARQVINGQFGNGNDKIQRVRSTGYDSVQVQERVNALLDKTPPFQLALKSVDELAQEVLNGKWGNGNRRKSALIGAGYNYDKVQAKVNELVSGNVTSSLKSIDEVAREVINGHWGNGQERKNRLTQVGYDYQKVQQKVNELL

SEQ ID NO: 2709 - protein, 341 aa, unidentified
  REGION 1..341: note = Solibaculum mannosilyticum
MNVVKMEMPQNMYSIKCPHTMTPTRIVVHNTANDASARNEIKYMQGNNKQVSFHIAVDDIEAVQGVPLDRNAWHAGDGANGTGNRQGIAIEICYSKSGGAKFEAAERNAAELIAQLLKERGWGIDKVTKHQDYSGKYCPHRTLDMGWQRFLDMVQGYMSGNSSGSGSTYTVQYGDTLTGIAKSLLGDASRYKEIAALNGIDNPNVIKVGQVLKIPGGYSDDSAPAAPSKSVDEIAQEVIAGKWGNGSERKERLTAAGYDYAAVQAKVNEIMGGSSSGTASSSIAVGDTVRITCSTYSTGQSIPSWVKNTTHKVSQIKGDKALLGYPDGIASWVPLSGITKA

SEQ ID NO: 2710 - protein, 156 aa, unidentified
  REGION 1..156: note = Thomasclavelia spiroformis
MERYHELTGVWPWVYGNAWRFNQGTVNTNCGRWVAGYPSNGITDINYGLNNDCAYKVNNGLVCAWQFSSSVRISGYSGNLDGDVFYGDAAAWDKYAGGSPASGGSGGSTTTPSGSVLSLAVGVMQGKYGNGNARKQKLEAAGYDYEAVQARVNALL

SEQ ID NO: 2711 - protein, 311 aa, unidentified
  REGION 1..311: note = Caudoviricetes sp.
MAYTNIELANKLKDIAQNYKTLYVMGCFGAPMTAANKRRYTQNHSYNKQASRTAMINAASADTFGFDCVCLIKGVLWGWNGSKTATYGGAKYACNGVPDIGADSMINVCKNISTDFSKIEVGEAVWMSGHIGVYIGEGLAVECTPKWANKVQITACNCSKSGYNRRNWTKHGKLPYITYVQQTDPVTPAKPETPSSDTTFKKGDLVKITGTKYLGGKTIPLWVRLKKWYVLEGGSKRVVIDKSEDGKNSICSAVSADCLQLVKSTSSKSVDELAREVINGKWGNGSARKKKLTAAGYDYGAVQKRVNELMK

SEQ ID NO: 2712 - protein, 255 aa, unidentified
  REGION 1..255: note = Caudoviricetes sp.
MSVQGIDVSRHNTITDFRKVKGSGIDFVIIRAGYGREISQKDPQFETNYKNAKAAGLNVGAYWYSYAQSVEEAKIEAKVCLQAIKGKKFEYPIYFDLEENTQLSRGSAFCSALVKAFCGELEKAGYFAGLYMSRYYLQTVISSDVAKRYAVWVAEYNGKCNYSGNYGIWQNSSTWRVNGISGNVDHDYAYIDYPSIIKKKGLNGYKAATAKKSIDTIAREVIAGKWGNGNERKKKLTAAGYDFAAVQKRVNQLIP

SEQ ID NO: 2713 - protein, 255 aa, unidentified
  REGION 1..255: note = Caudoviricetes sp.
MSVQGIDVSRHNTITDFRKVKVSGIDFVIIRAGYGREISQKDPQFETNYKNAKAAGLNVGAYWYSYAQSVEEAKIEAKVCLQAIKGKKFEYPIYFDLEENTQLSRGSAFCSALVKAFCGELEQAGYFAGLYMSRYYLQTVISSDVAKRYAVWVAEYNGKCNYSGNYGIWQNSSTWRVNGISGNVDHDYSYIDYPSIIKKKGLNGYKTGTAKKSIDTIAREVIAGKWGNGNERKKKLTAAGYDFAAVQKRVNQLIP

SEQ ID NO: 2714 - protein, 307 aa, unidentified
  REGION 1..307: note = Caudoviricetes sp.
MIRMAILKPDTTTTMNGVTVNEYLLTKHNPNRIAMPSASMEGKIIGVTVHNTDWISVASGTTPAEQYTRATVNGNMKDVRVHYYVDNTCAWQNLPHSLSGWHAADGSGNGNRRTIAIECIMSSAYNVTDKKSEDNCARLAAALLKKYNLDINHLFTHTHWLNVRDGKSGTVDYLNTAKNPYKTCPLYILPHWFAFKAKVQSYMKSGTSVSKNPTTKLLYRVRKSWSDAKSQIGAFSSLDNAKKACKPGYYVFDANGNVVYPTKKSVDEIAREVIQGKWGNGTDRKKRLTNAGYDYNAVQKRVNELMK

SEQ ID NO: 2715 - protein, 184 aa, unidentified
  REGION 1..184: note = Clostridia bacterium
MVAYRKYKNGASNLWYGYPNYDNEDVSDGSAPATGAKTVDEIAKEVINGKWGNGNDRKQRLTAAGYDYSVVQNRVNELVSGKTSTPAKSIDELAKEVLAGKWGNGDARKTALTNAGYDYAKVQERVNELVKQNNASSIVYYTVVKGDTLSKIAKKYGTTVNRIVKWNNIANPNLIYVGQKFRVK

SEQ ID NO: 2716 - protein, 304 aa, Ruminococcus sp.
MAILRPDSTSTLGGVTVKEYLLTKHNPNRIDMPSVSMTGKIIGVTVHNTDWISVASGTTPAEQYTRATVNGNMNDVRVHYYVDNTCAWQNLPLTLSGWHAADGSGNGNRRTIAIECIMSSAYNDRDKKSEDNSAKLAAALLKKYNLGVDHLYTHTHWLNVRDGKSGSVDYLNTARNPYKMCPLYILPHWSAFKAKVQSYMKSGTSVSTNPTTKQLYRVRKSWSDAKSQIGAFASLDNAKKACKSGYSVFDGNGNVVYPTKKSVDEIAGEVIQGKWGNGTDRKNRLTNAGYDYNAVQKRVNELMK

SEQ ID NO: 2717 - protein, 465 aa, unidentified
  REGION 1..465: note = Lachnospiraceae bacterium
MTIIKALATWGACYKAARKMPKGVPEGIVVHSTGANNPNLKRYVNAPDVCGENPNKNYFGSDGTDVNPHAVIGKDKNGAVKCAQILPFDICCWGCGSGSKGSYNYNPAYIQFEICEDGLTDKAYFEAAFDLAAQFCAELIGQFPSIKIENVVSHKEANARGYASAHGDPENWLAKFGKNMDWFRDKVKGYLGNTAVTYAKLSEILGTTNASITTIFREKGSCWSSGWHNGIDIAAPANTPIKAAADGVVVNADTTANADGYGNRVVIRHPDGKATLYAHMIAPAAVKVGQAVKKGAVIGKVGSTGKSTGNHLHISVIDNYDRNPDIYYKGELLDPVDVLGLGTLKLNGSTATAFKVGDIVNFTGTTHYASSTGTRGTSCKSGKAKITSISANAAHPYHLVSDGLSGSTVYGWVNAADIAAEKSLDEIAREVIRGDWGNGDERKKRLTAAGYDYSAVQKKVTELMK

SEQ ID NO: 2718 - protein, 304 aa, Ruminococcus callidus
MTILRPDATTTLNGVKINEYLLTKHNPNHIDMPSVSMAGKIIGVTVHNTDWITVASGTTPAEQYTRATVNNNMKDVRVHYYVDNVCAWQNLPHSLSGWHAADGSGNGNRRTIAIECIMSSAYNSTNKKSEDNCAKLAAALLKQYGLDINHLYTHTHWLNVRDERNGTVDQLNTMYNRYKMCPAYILPHWAEFKKKVQSYMKSGTSVSKNPTTKQLYRVRKSWSDAKSQIGAFSSLDNAKKACKSGYSVFDANGNVVYPTKKSIDEIAREVIQGKWGNGTDRKNKLTNAGYDYNAVQKRVNELMK

SEQ ID NO: 2719 - protein, 178 aa, Ruminococcus sp.
KKSEDNCAKLAAALLKQYGLDINHLYTHTHWLNVRDGKSGTVDQLNTMYNRYKMCPAYILPHWAEFKKKVQSYMKSGTSVSKNPTTKQLYRVRKSWSDAKSQIGAFSSLDNAKKACKSGYSVFDANGNVVYPTKKSIDEIAREVIQGKWGNGTDRKNKLTNAGYDYNAVQKRVNELMK

SEQ ID NO: 2720 - protein, 304 aa, Ruminococcus callidus
MAILKPDTTTTMNGVTVNEYLLTKHNPNRIAMPSASMEGKIIGVTVHNTDWISVASGTTPAEQYTRATVNGNMKDVRVHYYVDNTCAWQNLPHSLSGWHAADGSGNGNRRTIAIECIMSSAYNVTDKKSEDNCARLAAALLKKYNLDINHLFTHTHWLNVRDGKSGTVDYLNTAKNPYKTCPLYILPHWFAFKAKVQSYMKSGTSVSKNPTTKLLYRVRKSWSDAKSQIGAFSSLDNAKKACKPGYYVFDANGNVVYPTKKSVDEIAREVIQGKWGNGTDRKKRLTNAGYDYNAVQKRVNELMK

SEQ ID NO: 2721 - protein, 304 aa, unidentified
  REGION 1..304: note = uncultured Ruminococcus sp.
MAILRPDTSTTLNGVKINEYLLTKHNPNRIDMPSVSMEGKVIGVTVHNTDWISVASGTTPAEQYTRATVNGNMKDVRVHYYVDNTCAWQNLPHSLSGWHAADGSGNGNRRTIAIECIMSSAYNVTDKKSEDNCARLAAALLKKYNLDINHLFTHTHWLNVRDGKSGTVDYLNTARNPYKMCPLYILPHWSAFKSKVQSYMKSGTSVSKNPTTKLLYRVRKSWSDAKSQIGAFSSLDNAKKACKPGYYVFDANGNVVYPTKKSVDEIAREVIQGKWGNGTDRKKRLTNAGYDYNAVQKRVNELMK

SEQ ID NO: 2722 - protein, 304 aa, unidentified
  REGION 1..304: note = uncultured Ruminococcus sp.
MAILRPDTSTTLNGVKINEYLLTKHNPNRIDMPSVSMEGKVIGVTVHNTDWISVASGTTPAEQYTRATVNGNMNDVRVHYYVDNTCAWKNLPLTLSGWHAADGSGNGNRRTIAIECIMSSAYNSKDQKSEDNAAKLAAALLKKYNLGIDNLYTHTHWLNVRDGKSGSVDYLNTARNPYKMCPLYILPHWSAFKSKVQSYMKSGTSVSKNPTTKQLYRVRKSWSDAKSQIGAFSSLDNAKKACKSGYSVFDANGNVVYPTKKSVDEIAREVIQGKWGNGTDRKKRLTNAGYDYNAVQKRVNELMK

SEQ ID NO: 2723 - protein, 304 aa, unidentified
  REGION 1..304: note = uncultured Ruminococcus sp.
MAILRPDTSTTLNGVKINEYLLTKHNPNHIDMPSVLMEGKIIGVTIHNTSWITTASGTTPAEQYTRATVNGNMNDVRVHYYVDNTCAWKNLPLTLSGWHAADGSGNGNRRTIAIECIMSSAYNSKDQKSEDNAAKLAAALLKKYNLGIDNLYTHTHWLNVRDGKSGSVDYLNTARNPYKMCPLYILPHWSAFKSKVQSYMKSGTSVSKNPTTKQLYRVRKSWSDAKSQIGAFSSLDNAKKACKSGYSVFDANGNVVYPTKKSVDEIAREVIQGKWGNGTDRKKRLTNAGYDYNAVQKRVNELMK

SEQ ID NO: 2724 - protein, 304 aa, Bacteroides acidifaciens
MAILKPDKTTNLGGVTVNEYLLTNHNPNHIDMPSISMEGKIVGVTVHNTDWITTAAGTTPAEQYTRATVNGNMKDVRVHYYVDNACAWQNLPLSLSGWHAADGSGNGNRRTIAIECIMSSAYNDKDKKSEDNCARLAAALLKKYNLDINHLYTHTHWLNVRDGKSGTVDYLNTAKNSYKNCPAYILPHWAEFKKKVQSYMNSGSSAPETPSAKQIYRVRKTWSDAKSQIGAFSSLENAKKACKAGYTVFDSSGKQVYPAKKSVDEIAREVIQGKWGNGAERKKKLTDAGYDYNAVQKRVNELFR

SEQ ID NO: 2725 - protein, 92 aa, unidentified
  REGION 1..92: note = uncultured bacterium
YKDYKTIIQSSGLNHLAKEESTPAPTEKKSVETLAKEVIQGLWGNGEERKKRLTDAGYDYVAVQSKVNEMLSSKKSIDAIAKEVIRGDWGNG

SEQ ID NO: 2726 - protein, 253 aa, unidentified
  REGION 1..253: note = Ruminococcus sp. CAG:579
MRGIDISQFQGNVNFSKVKKSGIEFVMIRAGFGRYETQRDPYFERNYKAAKAAGFHVGAYWYSYAQSVDDAKQEAKVCMKIINGKQFDFPIFFDLEERSQFAKGRDHCDGLVKAFCGELEKNGWFAGLYISRSPLQTYISPTVAKRYALWVAEYGSRCNYGGSYGIWQYSSTGRVSGISGNVDLDVSSVDYPSVIRKGGFNGYAKGSDKKSVDTLAREVLSGKWGNGAERKKRLTAAGYDYAKVQKRVNELLR

SEQ ID NO: 2727 - protein, 316 aa, unidentified
  REGION 1..316: note = Caudoviricetes sp.
MSQKFGIDVSHWQGDFNFARAKSNEGVEFAIIKAGGGDAGLYKDSKFESNYKRCEECGLPKGAYFYGNAKSVAEAKKEAEYFISILSGKKYEYPVFYDVEGRMITDNDRVTLTEIVKAFCSIMEAAGYWVGIYSSESFFNSEMNDGELTRYSHWVARWGKSKPAPSSGAETQMWQFGGETNLIRSNKINGQTCDQDYCYVDYPAKIKAAGLNGYSKGSSSAPARKSNAEIANEVIAGKWGNGTERKERLAEAGYNYSEIQEIVNGKLGVNPKKSVDEIAREVIHGDWGNGNERKQRLENAGYNYSEIQARVNKLLS

SEQ ID NO: 2728 - protein, 311 aa, unidentified
  REGION 1..311: note = Caudoviricetes sp.
MSVKGIDVSVWQGNIDFNRVKSAGIDFVIIRAGYGNGNKDKCFEENYRRAKSAGLHVGAYWYSYASSIDGAKQEAQAFANVLSGKQLDYPVYFDIEEKSQLSLGRDFCSNIITAFCTEMEKHGYYAGFYTSLSALNSIVSDAVKNRFTLWVAQWAGKCSYSGKYGIWQFSSESNVAGINGYVDMDYSYIDFPAIIKNGEFNGYNKAHSTNAPATPKKSVDELASEVIAGKWGDGTDRKNRLSAAGYDYNAVQSKVNEKLGGSAIYYTVRNGDTLSAIARKYGTTVFAIQKLNAALIKNVNLIQVGWKIRVK

SEQ ID NO: 2729 - protein, 316 aa, unidentified
  REGION 1..316: note = Caudoviricetes sp.
MAIKGIDVSVWQGNIDFGKVKVSGINFVIIRAGYGNGNKDKWFDENYRKAKAAGLHIGAYWYSYATSADGAKQEAQSCAKVLSGKQLDYPVYFDIEEKSQLSRGKDFCSSLITAFCTELENHGYYAGFYTSLSSLNSVVSDAVKKRFTVWVAQWSGKCSYSGAYGVWQYSSKGKVSGIGGNVDMDYSYIDFPTTIRNGGFNGYGKGAASTSTTTVKKSVDEIASEVIAGKWGNGSDRKNRLTAAGFDYNAVQAKVNEKLGASQKKSAATYYTVQRGDTLSGIAKKYGTTVSTIQKLNSSLIKNVNLIQVGWRIRVK

SEQ ID NO: 2730 - protein, 285 aa, unidentified
  REGION 1..285: note = Caudoviricetes sp.
MSYTNSKLISYTKISPNRNINRNHKIDTVSIHCVVGQCSVETLGSIFASRDKEASSNYGIGYDGRIGMYVEEKDRSWCTSSASNDNRAITIEVASDTYHPYRVNDAAYKSLIKLLVDICKRNGIKRLVWSTNKSERMNHLNGCNMTVHRDYANKSCPGDYLYNLHGQIAKEVNAQLGLGSSKPVTSKKTLYRVRKSWKDAKSQKGAFYDLSNAKKCADKNSGYSVFNESGKVVYTLKSSGKKSVDAIAREVIQGKWGNGADRKNRLTKAGYDYNAIQKRVNEILS

SEQ ID NO: 2731 - protein, 316 aa, unidentified
  REGION 1..316: note = Caudoviricetes sp.
MSQKFGIDVSHWQGDFNFARAKSNEGVEFAIIKAGGGDAGLYKDSKFETNYKKCEDCGLPKGAYFYGNAKSVAEAKKEAEYFISILSGKKYEYPVFYDVEGRMITDNDRAILTEIVKAFCSTMEAAGYWVGIYSSESFFNSEMNDSELTRYSHWVARWGKSKPAPSSGAETQMWQFGGETNLIRSNKINGQTCDQDYCYVDYPAKIKAAGLNGYSKSDSSAPAKKSNVEIANEVIAGKWGNGAERKERLSDAGYNYSEIQEIVNGKLGVKSKKSVDEIAREVICGDWGNGNERKQRLANAGYNYSEIQARVNKLLS

SEQ ID NO: 2732 - protein, 122 aa, Listeria innocua
MNYAYKDYKAIIRSAGLNHLGKEENIPAPTEKKSVETLAKEVIQGLWGNGEERKKRLVDAGYDYVAVQSKVNEILSSKKSIDTIAKEVIRGDWVNGQERKNKLTKAGYDYISVQKRVNELLK

SEQ ID NO: 2733 - protein, 88 aa, Ruminococcus sp.
MGVGSQKGAFYDLSNAKKCANKNSGYSVFNESGKVVYTLKSSGKKSVDAIAKEVIQGKWGNGADRKNRLTKAGYDYSAIQKRVNEILS

SEQ ID NO: 2734 - protein, 359 aa, unidentified
  REGION 1..359: note = Candidatus Onthocola stercoravium
MEFKGIDVSTHQGIIDWEKVKADGIQFALIRASYGSKSVDAQFKRNADECTRLNIPFGAYLYSYARNTEEAKNEVQNFINAIKPYKLSYPAIIDMEDADSYKSKNGVSYATCIDICEVECIALEQAGYYAMIYANLDWLNNKINSSRLDRFDKWVAQWNSSCNYSKPYGIWQYTSSGKVEGINGNVDMNKSYKDYPSIIAGMKSNNTSAEVTQKSIEELANEVINGKWGVGEDRKKRLTEAGYNYDTVQAKVNEIMGVTQKSIEELADEVISGKWGVGEDRKKRLTEAGYDYDTVQAKVNEKMGVNNSSSEITYTVKKGDTLSSIASKYNTTWQKIYEKNKSAIGSNPNLIHAGLKLKI

SEQ ID NO: 2735 - protein, 290 aa, unidentified
  REGION 1..290: note = Eubacterium plexicaudatum ASF492
MAYTNSSMVSYTGLSPNHSGQRTHSIDRITPHCVVGQLSAESICGCFTSPSRQASCNYGIGTDGKVSLCVEEKNRSWCSSSNANDQRAVTIECASDKTESYAMNSKVYDSLIKLCTDICRRNGKKKLLWLGDRNKTLNYTPKSDEMVLTVHRWFANKSCPGNWLYSRLGDLAAKVTESLGSTSESKPASNKKQLYRVRKTWADSRSQKGAFSVLANAKKCADSNKGYSVFDGNGKKVYPADAPGTKKSVDAIAREVVRGDWGNGDERKQKLTAAGYDYSAVQKKVNELLK

SEQ ID NO: 2736 - protein, 303 aa, unidentified
  REGION 1..303: note = Oscillospiraceae bacterium
MTMKGIDVSGWQGKIDFAKVKASGVEFVIVKAGYATSTVDTFESNYAAAKAAGLHVGAYWYSYADSVEGALAEAKACINAVKGKQFDMPIYFDLEEQSQFNKGKEFCTKLVETFCGELEKTGLFTGLYMSRWFLENYIFESVRKRFAIWVAEYSSVNRYKGTYGIWQYGVGRVSGIDGDCDMDIGYIDYPAIITNAGLNGYGKSESPESPTEKSIEEVAREVIRGDWGNGEERKKRLTEAGYDYYAVQREVDKLLNPPKKSVEEIAKEVIRGDWGNGEERKKRLTEAGYDYYEVQKAVNSMLN

SEQ ID NO: 2737 - protein, 314 aa, unidentified
  REGION 1..314: note = Oscillospiraceae bacterium
MNFTNSPLVNYTKISPFRTPNRNHAIDTVTIHCVVGQCAIESLGELFQTKECSSNYGIGYDGRIGMYVEEKDRSMCSSSASNDHRAITIEVASDTKEPYAVRPAAYNALIRLLVDICKRNGIKKLVWSTNKNDRVNHLNGCNMTAHRDYHSGKSCPGTYLYEREGQIAAEVNKLLGVEDSAGTLGTSESTLYRVQIGAFSDCKNAENYLAKAKASGFVGFVIRSDDNLLRVQIGAFTSKQNAENYLEKARAEGFDGFVVKTSNAAQSEPKKSVDEIAREVIHGDWGNGDERKKRLTEAGYDYYAVQARVEELLK

SEQ ID NO: 2738 - protein, 197 aa, Solobacterium sp.
MGLKDLFKKKDNVEQVKEEVKEVAAEVKEHVQPIASFKGGKETTEHVKPVASFKGGKEVTEHVKPVASFKGGKEVTEHVQPVASFKGGENQLETPKPAVDLMEVANKVIRGEYGNGEDRKVALEKAGFNYDEVQAKVNEILSGAKPAAAPAGLKPLEEIAKEVIRGDYGNGADRKAALEKLGYNYDEVQAKVNELLK

SEQ ID NO: 2739 - protein, 297 aa, Pseudobutyrivibrio sp.
MGKISNSGKDEKGKYTGGKAGDQTHEEWNIRDWYDRPWTAVLRYPDPEVRNLIAELAEKAANNDHIGYDQWERTTFWKQLEASGYDPANITVDCESDCSAGVAAIVKAVGFLKGIDKLKNVPETMYTGNERKNLKNAGFEAITDPNYLKSDTNLVRGDILLYHNSKSGSGHTAIYLSNPVEIQNGGKSIDELAQEVIAGKWGNGDDRKNKLTTAGYSYDEVQKKVNEILGASKPAPSYSTYEVIANSGLRLRPEPNTIKPEIRVLPKGTKIKVVSINNGWAKLEGEGYVSANYIRKV

SEQ ID NO: 2740 - protein, 298 aa, unidentified
  REGION 1..298: note = Candidatus Faecinaster equi
MISNCGHDENGKFHSGKAGDQTKTEWEIRAWFNKPWTHVLWHPDEKVRLMMAADAEKAARNDNIGYDQWQRTTFWTELKNANYKVEDIKNKCESDCSSGVAALAKAAGYKLGYDKLKNIPETTYTGNMIRNFKDAGFVVSTDPMYLTSDKYLEPGYILFIHDDKLGKHHAAINLSMGANVTKNQNEAKKSIDDIANEVIAGKWGNGSERKKRLESNGYNYSEVQAVVNSKISTSAPKYTTYEVVGISSWLNVRNAPNTNNDAVGKLYNGDKVKVVSISNGWAKLDNGNYISAKYIKKV

SEQ ID NO: 2741 - protein, 164 aa, unidentified
  REGION 1..164: note = Erysipelotrichaceae bacterium
MGLFDGFKKKAEEAKQATVAKAEEAKKDIDTLAKEVVDGRWGSTDQEIKQKLEAAGYDTYLQVKSKANSLIKAAADAKAAAEAAAKAAAKKAEEAREAAKAARIEELAKEVIQGKWGNGQERKDKLTAAGYDYSAVQGKVNELLNSGKDLETVAKEVIQGKWGN

SEQ ID NO: 2742 - protein, 59 aa, unidentified
  REGION 1..59: note = Oscillospiraceae bacterium
LPLEGKVPPQGADEVSLTAIAREVIAGKWGNGADRRRRLTAAGHDYKAVQTEVNRLLKG

SEQ ID NO: 2743 - protein, 88 aa, unidentified
  REGION 1..88: note = Erysipelotrichaceae bacterium
EELAKEVIQGKWGNGQERKDKLTEAGYDYSEVQGKVNELLASAKKDIEEVAKEVIRGKWGNGQERKDKLTAAGYDYSAVQAKVNELLK

SEQ ID NO: 2744 - protein, 166 aa, unidentified
  REGION 1..166: note = Erysipelotrichaceae bacterium
KKDIDTLAKEVVDGRWGSTDQEIKQKLEAAGYDTYLQVKSKANSLIKAAADAKAAAEAAAKAAAKKAEEAREAAKAARIEELAKEVIQGKWGNGQERKDKLTAAGYDYSAVQGKVNELLNSGKDLETVAKEVIQGKWGNGQERKDKLTAAGYNYSEVQALVNKLLG

SEQ ID NO: 2745 - protein, 90 aa, unidentified
  REGION 1..90: note = Erysipelotrichaceae bacterium
ARIEELAKEVIQGKWGNGQERKDKLTAAGYDYSAVQGKVNELLNSGKDLETVAKEVIQGKWGNGQERKDKLTAAGYNYSEVQALVNKLLG

SEQ ID NO: 2746 - protein, 191 aa, unidentified
  REGION 1..191: note = Erysipelotrichaceae bacterium
MGLFDGFKKKAEEAKQATVAKTEEVKKDIDTLAKEVVDGRWGSTDQEIKQKLEAAGYDTYLQVKSKANSLIKAAADAKAAAEAAAKAAAKKVEEAREAAKAARIEELAKEVIQGKWGNGQERKDKLTAAGYDYSAVQGKVNELLNSGKDLETVAKEVIQGKWGNGQERKDKLTAAGYNYSEVQALVNKLLG

SEQ ID NO: 2747 - protein, 131 aa, unidentified
  REGION 1..131: note = Erysipelotrichaceae bacterium
LQVKSKANSLIKAAADAKAAAEAAAKAAAKKAEEAREAAKAARIEELAKEVIQGKWGNGQERKDKLTAAGYDYSAVQGKVNELLNSGKDLETVAKEVIQGKWGNGQERKDKLTAAGYNYSEVQALVNKLLG

SEQ ID NO: 2748 - protein, 192 aa, unidentified
  REGION 1..192: note = Erysipelotrichaceae bacterium
MGLFDAFKKKTDEAKEEVKTQAAEVKKDVETLAKEVMDGAWGKTDDEIKAKLEAAGYDNFLHVKSKVNNLIKAAEDAKKAAEAAAKEAAAKVEAERLAKRAARIEELAKEVIQGKWGNGQERKDKLTEAGYDYSEVQGKVNELLASAKKDIEEVAKEVIRGKWGNGQERKDKLTAAGYDYSAVQAKVNELLK

SEQ ID NO: 2749 - protein, 244 aa, Eubacterium sp.
MKIKGVDLSYCQEGISFPALKQAGVKFAIIRAGFSTKKDVTMGKFVADCKKYGVDYGFYWYSYAMNVGQAQTEAEKCIEVIKNLSPTYPVFFDMEEKKQISGLNTDTRTKMAIAFCEKIRQAGFKPGIYANPSFMENYYDKSRIVGKYDIWLAHWTKSPDCPSKYNYGQTMWQWGLDRIGGYDVDGDICFCEYVNPTPVKKTVEQLAKEVIRGDWGNGAERKQKLTAAGYDYSAVQKRVNKLLR

SEQ ID NO: 2750 - protein, 199 aa, unidentified
  REGION 1..199: note = Erysipelotrichaceae bacterium
MGLFDAFKKKTDKVKEEVKEGTAKAKEEIVQAKKDIETLAKEVMNGDWGKTDDEIKAKLQAAGYDNFLHVKSKVNNLIKAAEDAKKAAEAAAKEAAAKIEAERLAKRAAKIEELAKEVIQGKWGNGQERKDKLTEAGYDYSEVQGKVNELLASEKKEIEEIAREVIRGKWGNGQERKDKLTAAGYDYSAVQAKVNELLK

SEQ ID NO: 2751 - protein, 426 aa, Clostridium symbiosum
MAREKFIADIAGYVKKYAGQYGILVYSPVIAQAVLESGWGESRLASQYHNYFGLKCGTRWTGRSVNMRTQEEYMEGTLTSIRDNFRVFDSMEEGVKGYFEFIQLERYRNLQGIRDPQEYLETIRADGYATSFSYVEDCMKVIRQYELTRFDEGGCETMAKTAESVLDVMRGWLGFSEANGKFKEIIDLYNSVKPLPRGYAVQYSDEWCDTCVSAAGIKAGCSELIGRECGVEEHVKIFKKLGIWIEDGTITPEPGYVIVYNWDKAAQPNDGYSDHIGFVEKVSGGMVTAIEGNRGEKVDRRVLPLGWGFIRGYAAPRYEKAANETGGNTGTGKKSVEAVAKEVLAGKWGNGEDRKKRLQAAGYDYGAVQAKVNELVKGSGKKSVDAVAKEVIAGKWGNGANRKKKLQAAGYDYGAVQKRVNEMLKK

SEQ ID NO: 2752 - protein, 82 aa, unidentified
  REGION 1..82: note = Oscillospiraceae bacterium
CPGDWLYSRLGNVAKEVTKALNTPNKKGSTSKENTTKKKSIDSIAREVINGKWGNGTDRKKQLTKAGYDYNAVQKRVNELLK

SEQ ID NO: 2753 - protein, 63 aa, Ruminococcus sp.
ALNTPNKKGSASKENITKKKSIDTIAREVINGKWGNGADRKKRLLSAGYDYNTVQKRVNELLR

SEQ ID NO: 2754 - protein, 319 aa, unidentified
  REGION 1..319: note = Bacillota bacterium
MSEIKRFGIDVSHWQGDFDFARAKSKEGVEFAILKAGGGDAGLYKDSKFETNYKKCEACGLPKGAYFYGNAKSTAEAKKEAEYFISILGGKKYEYPVFYDVEGKMITDNDRVTLTEIVKTFCSIVEAAGYWVGIYSSESFFNSEMNDGELTRYSHWVARWGKSKPAPASGAETQMWQFGGETNLIRSNKINGQTCDQDYCYVDYPVKIKAAGLNGYDKSQEVPTPTKKSNAEIADEVIAGKWGNGAERKEKLTKAGYNYSEIQSIVNAKIGTPAKKSVDEIAKEVIRGDWGNGSERKARLTAEGYDYAVIQHRVNERLS

SEQ ID NO: 2755 - protein, 509 aa, unidentified
  REGION 1..509: note = Lachnospiraceae bacterium
MKLVESILTKNPCYTAGRKIDVKGLMLHSVGCSQPKASAFINSWNSPTFERACVHGFIDGNDGTVYQTLPWDHRGWHCGSSINGSGNNTHIGVEMCEPACITYTGGATFKCSDLATAKAVAERTYHAAVELFAMLCDKFGLDPLADGVVISHKEGHTRGIASNHGDPEHLWSQLGMGYTMDTFRKAVKAKMGGSVKTSGTQASEFANLTEAQAVAKIGPLCREDMKKSGILASVSAAQFILESGYGKSELAQNANNCFGMKKSLSGNSWSGSSWDGTSIYTKKTQEQHPDGTYETITADFRKYPCVEDSVADHSAYLLGAKNGRALRYKGIKGMTDYKAVAQLIKDGGYATSLTYVEKLCNIIEKWNLTQYDTQAADTPKPESPDTVKTFPETPFTVKVLIDDLNYRSEPSMKGTVNGQTRRGVFTIMEVKDGWGRLKSGAGWIWLENPTYCTVQGTVAKKETVAKTVDELAKEVIRGDWGNGQERKEKLTAAGYDYGTIQKRVNELLK

SEQ ID NO: 2756 - protein, 383 aa, unidentified
  REGION 1..383: note = Hornefia sp.
MTPHCVVGQCTAGGLGSWFAKTSTQASSNYGIDKDGRVGLYVEEKNRSWCSSSNSNDQRAVTIECASDTKEPYTMNSKVYATLVKLCVDICKRNGKKKLIWISNKSKALNYVPKSDEMILTVHRWFANKSCPGNWLYSRLGKLATEVTKLLGSSTASGLNASSLKDLSEADVIKKVGALFTADMRKSGILASVSLAQFILESGYGKSELAQKANNCFGMKKSLSGNTWSGSVWDGKSVYTKKTKEQNKDGSYTTITADFRKYPSVKDSIADHSAYLLGAKNGSKKRYAGLKGCKDYKKAAKIIKDGGYATSLTYVDTLCSIIEKWKLTQYDVKSSSSSKKSVDTLAKEVIAGKWGDGEERKQKLTAAGYDYNAVQKRVNEMLS

SEQ ID NO: 2757 - protein, 300 aa, unidentified
  REGION 1..300: note = Oscillospiraceae bacterium
MAILKPDKTTNLGGVTVNEYLLTNHNPNHIDMPSVSMEGKIIGVTVHNTDWITTAVGTTPAEQYTRATVNGNMKDVRVHYYCDNTCAWQNLPLTLSGWHAADGSGNGNRRTIAIECIMSSAYNDKDKKSEDNCARLAAALLKKYNLDINHLYTHTHWLNVRDGKWGTVDYLNTAKNSYKNCPAYILPHWANFKAKVQSYMNSGSSAPVTTQLYRVRKTWTDAKSQIGAYASLENAKRACKDGYSVFDWNGNIVYSCKKSIDEIAREVIQGKWGNGAERKKKLTAAGYDYNAVQKKVNEIL

SEQ ID NO: 2758 - protein, 317 aa, Bulleidia sp.
MTMNGIDISNWQAGINLSNIAFDFLIARATEGIGCVDKYCDGYIQQAIKLGKPFGFYHFARPTNDPIREAEFFYNSCRGYFGKGIPILDWESGNTSNVTWAKRWLDRVYQLSGVKPVIYMSESVVNANNWSAVAAADYGLWVAKYRDNNPDYNYNMANAGSRPHVKWWKFYCMWQWTSSGRLNGYNGNLDCDVFYGDRSTWDAYVGKSTSATKPQPKPVTKTVDQLADEVIAGQWGNGSDRKKRLTAAGYDYNAVQQMVNRKMAAKKQVAHVYYVVKRGDTLSGIASKYGTTYQRLAQINGIADPNKIYIGQKIKVK

SEQ ID NO: 2759 - protein, 213 aa, unidentified
  REGION 1..213: note = Eubacteriales bacterium
MGSVIGQYGNIIKFEVSDRKVLTFSDMERTQAGRWKEHEIPGVVPQSEFIGPSATEMSLKIQLKAQLGVKPRAMIATLEKCARNGTVDTLVIGGSKYGWGSAKWRVTSVSDKWERFVGGGLMEAGCTVDFKEYSESSKKVTIIKRPKPQPQKVPAAAKKPQTASYNVDDIARRVIRGEFGNGQARFNKLQSQGYNWKAVQNRVNQMLGCSKRY

SEQ ID NO: 2760 - protein, 85 aa, unidentified
  REGION 1..85: note = Lachnospiraceae bacterium
MAKEVISGAWGNSEARKAALELAGYNYGEVQKRVNILVKTTKSSIDAIAREVIAGKWGNGQDRKNRLNQAGYDYVAVQKRVDELM

SEQ ID NO: 2761 - protein, 122 aa, unidentified
  REGION 1..122: note = Erysipelotrichaceae bacterium MTC7
MNYAYKDYKAIIQSAGLNHLGKEENIPVPTEKKSVETLAKEVIQGLWGNGEERKKRLTDAGYDYVAVQSKVNEMLSSKKSIDAIAKEVIRGDWGNGQDRKNKLTNAGYDYISVQKRVNELLK

SEQ ID NO: 2762 - protein, 403 aa, unidentified
  REGION 1..403: note = Clostridiales bacterium 41_12_two_minus
MAYLNGIDVSNWQKGINLAAVPADFVICKATQGTTYVSPDCVRQVEQAAASGKLVGTYHYISGVGAVAEADFYLKNISNWIGKYMLCLDWESNQNSQWGNEAYLEQMVKRIIERTGIPPMIYVQQSRMSAVKPIAQRNNCGLWIAQYANMNQTGYQATPWNEGAYSCAIRQYSSAGRLSGYNGNLDLNKFYGDKNTWMKYCNPDSAHEDTGGSTTPSHPASPTGSTLDLVVGTMQGKYGNGDSRKTALGSRYDETQDMINHISTASASTLASEVKAGKYGNGETRKIALGSRYDEVQKIVNGSSKKSVSAIADEVIAGKWGNGNDRKNKLQAAGYDYNAVQAEVNKKLGSGSGSSSKQYYTIRTGDTLSEIAKANGTTVKQLQSWNGIKNANVIYAGQKIRVK

SEQ ID NO: 2763 - protein, 300 aa, unidentified; identical to SEQ ID NO: 2757
  REGION 1..300: note = Clostridiales bacterium 42_27

SEQ ID NO: 2764 - protein, 469 aa, unidentified
  REGION 1..469: note = Bacteriophage sp.
MDKQEFIKTIAGFVCKYAKQYGILVHSPIIAQAMLESGWGKSTLSSKYHNYFGLKCGTKWTGKSVNMTTQEEYQEGVHTTIKDNFRVYNSMEEGIKGYFEFIQLPRYSNLKGITDPLIYLETIKGDGYATSSTYVESNMQLVRQFNLTQYDKKEVNGMDRTAVVKQAQSWIGYNEGNGTHKRIIDVYNAHRPLARGYVVKYTDAWCATFVSACAIKTGCTAIIPTECSCEQMIRLFAQLGEWVENDAYVPSAGDVIFYDWDDNGSGDCTGFSDHVGIVEYVSGGMITVIEGNISNSVGRRKIKVNAKCIRGYGVPRYTTASKPSQPAPQKDLTVIAQEVIAGLWGNGSQRKSALELAGYNFNAVQAKVNEILSGKKPSAPSITIEQIAKEVLAGQWGNGQDRINRLTSAGYDANAVQNKVNQMVNSKSIDTVAREVIQGKWGNGAERKRRLTQAGYDFNVVQNRVNALL

SEQ ID NO: 2765 - protein, 492 aa, unidentified
  REGION 1..492: note = Enterocloster clostridioformis
MARTKGIDVSHWQGTIDWNKVKAAGIQFAIIKAGGSDAGTYTDSKWEANYKGAKAAGIPVGAYYFVGKDCVTAAAGKADAERFIQILKGKQLEYPVYMDNEAQPASAKAGITEATIAFCETMEAAGYFVGIYGSAVSGFKERMDDSKLTDYAHWVAQYASKCTYSGKYGIWQYSSKGSVDGISGNVDMDYGYIDYPSIIKTGGFNGYTKESTPAPVASSQRDSIIAQARAWLGKKESDGSHKVIIDTYNSHKPLARGYAMKYTDAWCATFVSAVSIKCGLTDILPTECSCGEMIALFKKLGEWIENDAHVPKPGDIIFYDWQDSGSGDNTGWPDHVGIVEAVSGSTITVIEGNKSDAVGRRTLQVGGKYIRGYGVPKYAEGSGSTPAPEPALTKTVDELAKEVIDGKWGNGTERKNRLTAAGHDYAAVQAKVNALLKKPTASSPVWYTVKSGDTLSAIARKYGTSVSAIQKLNPTLIKNVNLIITGWKIRVK

SEQ ID NO: 2766 - protein, 420 aa, unidentified
  REGION 1..420: note = Mediterraneibacter gnavus
MKKEEFIQKIAGYVKKYAAAYEIKVCSPIIAQAILESGWGESRLAKDYHNYFGLKCGTKWQGKSVNLATWEEYEAGTATVISDYFRVFDNMEEGVKGYFELLQLPRYQNLKGITEPRRYLETIWADGYATSSVYVQKNMELIEQYQLMKYDENASGRSAQDVLNVMRSWIGYSEANGKFRQIIDLYNSHQPLARGYAVQYTDEWCDTAVSAAAIQADCVDLIGTECGCEKHIEIFKEKGIWIEDGTIVPLPGDIILYNWDFQVQPNDGYSDHIGYVESVSGQMITVMEGNYNEAVARRKIPAGWGQIRGYARPKYAEGVTGQPSKSIEEVAGEVIQGKYANGKERRKKLCDMGYDPDAVQREVNRQLSQNEAPAEYYVVQENDTLSEIAKCFATTYLELAAWNGIADPNMIYVGQKIRIR

SEQ ID NO: 2767 - protein, 316 aa, Ethanoligenens harbinense
MAIKGIDVSVWQGNIDFGKVKVSGINFVIIRAGYGNGNKDKWFDENYRKAKAAGLHIGAYWYSYATSADGAKQEAQSCAKVLSGKQLDYPVYFDIEEKSQLSRGKDFCSSLITAFCTELENHGYYAGFYTSLSSLNSVVSDAVKKRFTVWVAQWSGKCSYSGAYGVWQYSSKGKVSGIGGNVDMDYSYIDFPTTIRNGGFNGYGKGAASTSTTTVKKSVDEIASEVIAGKWGNGSDRKNRLTAAGFDYNAVQAKVNEKLGASQKKSAATYYTVQRGDTLSGIAKKYGTTVSAIQKLNSTLIKNVNLIQVGWRIRVK

SEQ ID NO: 2768 - protein, 313 aa, unidentified
  REGION 1..313: note = Coriobacteriia
MLNGIDISSWQTGIDLSVVPCDFVVIKATGGIGYVNPDCDRAYQQAKAQGKKLGFYHYAREKGYKGSAADEARFFIDSCRNYFGEAIPVLDWEEELSAGVSWAKEFLDAVYAETGVKPLLYASKSVLREYDWSSVANAGYGLWFAQYANYNATGYQDSPWTDNGGIGAWPFPAMFQYSSAGSLPGWNGSLDLNIFFGDESAWDAYASAGSGSTEPNAEPVKSVDDIAHEVIAGAWGNGDERRARLAAAGYDFDTVQGRVNDLLGANRQRIYTVVAGDTLSGIGAKLGVDWRSIASSNGISSPYTIYPGDQLTY

SEQ ID NO: 2769 - protein, 285 aa, unidentified
  REGION 1..285: note = Eubacterium sp. OM08-24
MSYTNSKLVSYTKISPNRNINRNHKIDTVSIHCVVGQCSVETLGSIFASRDKEASSNYGIGYDGRIGMYVEEKDRSWCTSSASNDNRAITIEVASDTYHPYRVNDVAYKSLIKLLVDICKRNGIKRLVWSTNKSERMNHLNGCNMTVHRDYANKSCPGDYLYNLHGQIAKEVNAQLGLGSSKPATSKKTLYRVRKSWKDAKSQKGAFYDLSNAKKCADKNSGYSVFNESGKVVYTLKSSGKKSVDAIAREVIQGKWGNGADRKNRLTKAGYDYNAIQKRVNEILS

SEQ ID NO: 2770 - protein, 285 aa, Ruminococcus bromii
MSYTNSKLVSYTKISPNKNINRNHKIDTISIHCVVGQCSVETLGSIFASASKEASSNYGIGYDGRIGMYVEEKDRSWCTSSASNDNRAITIEVASDTYHPYRVNDAAYKSLIKLLVDICKRNGIKRLVWSTNKSERMNHLNGCNMTVHRDYANKSCPGDYLYNLHGQIAKEVNAQLGLGSSKPATSKKTLYRVRKSWKDAKSQKGAFYDLSNAKKCADKNSGYSVFNESGKVVYTLKSSGKKSVDAIAREVIQGKWGNGADRKNRLTKAGYDYNAIQKRVNEILS

SEQ ID NO: 2771 - protein, 372 aa, unidentified
  REGION 1..372: note = Mediterraneibacter gnavus
MKKEEFIQKIAGYVKKYAAAYEIKVCSPIIAQAILESGWGESRLAKDYHNYFGLKCGTKWQGKSVNLATWEEYEAGTATVISDYFRVFDNMELIEQYQLMKYDENASGRSAQDVLNVMRSWIGYSEANGKFRQIIDLYNSHQPLARGYAVQYTDEWCDTAVSAAAIQADCVDLIGTECGCEKHIEIFKEKGIWIEDGTIVPLPGDIILYNWDFQVQPNDGYSDHIGYVESVSGQMITVMEGNYNEAVARRKIPAGWGQIRGYARPKYAEGVTGQPSKSIEEVAGEVIQGKYANGKERRKKLCDMGYDPDAVQREVNRQLSQNEAPAEYYVVQENDTLSEIAKRFATTYLELAAWNGIADPNMIYGGQKIRIR

SEQ ID NO: 2772 - protein, 321 aa, unidentified
  REGION 1..321: note = Intestinibacillus sp. Marseille-P6563
MARINGIDVSHWQGTIDWDKVKAAGIEFAIIKAGGSDAGFYTDSKWEENYMGAKAAGIPIGAYYFVGRDCVTAAAGKADAERFIKILKGKQLEYPVYMDNEAQPASAKAGITEAAIAFCETMEAAGYFVGIYGSAVSGFQERMDDSKLKAYSHWVAQYASKCTYSGEYGIWQYSSTGKVDGIKGNVDMDYGYIDYPSIIKNGGFNGWSKGSAAATYTKSVDELAAEVINGKWGNGEERKKKLTSAGYDYTAVQAKVNEILSGKNASTTATYETYTVLKGDTLWGIASKKLGSGARYKEIKTLNGLSSDTIYSGQKLKMPKK

SEQ ID NO: 2773 - protein, 465 aa, unidentified
  REGION 1..465: note = Romboutsia ilealis
MSYKGIDVSHYQGNIDWKKVKENIDFAILRLGWIGNTNHTLDTKFETYYKACKREGIPIGVYVYNYCNTQERAESGAKWAVNQLKGKSIDLPVYIDMEDSKIEHLGKVKLTNICIAFNTVIENAGYWAGVYANLNWYTNYLNKDTIKARYTTWVANYGVSQDRYKGQYDMLQYSDTGKVPGISGNVDMNIMYRDLINEIKGSNPGTDKKTIEELAKEVIAGQWGNGEERKIKLINAGYDYEAVQAKVNEILQSTDRKTVEELAKEVIAGQWGNGEERKTRLTNAGYDYEAVQAKVNEILGSTDRKTVEELAKEVIAGQWGNGEERKTRLTNAGYDYEAVQAKVNEILESTDRKTIEELAKEVIAGQWGDGEERKTRLTNAGYDYAAVQAKVNEMLEENTSTTNYYPPVSSTYNSIVEALNSIGVDSSFNNRKQIAIKNGINDYTGTAEQNIELLNKLKDGKLIEI

SEQ ID NO: 2774 - protein, 428 aa, unidentified
  REGION 1..428: note = Lachnospiraceae
MRIAREKFIADIAGYVKKYAGQYGILVYSPVIAQAVLESGWGESRLASQYHNYFGLKCGTRWTGRSVNMRTQEEYMEGTLTSIRDNFRVFDSMEEGVKGYFEFIQLERYRNLQGIRDPQEYLETIRADGYATSFSYVEDCMKVIRQYELTRFDEGGCETMAKTAESVLDVMRGWLGFSEANGKFKEIIDLYNSVKPLPRGYAVQYSDEWCDTCVSAAGIKAGCSELIGRECGVEEHVKIFKKLGIWIEDGTITPEPGYVIVYNWDKAAQPNDGYSDHIGFVEKVSGGMVTAIEGNRGEKVDRRVLPLGWGFIRGYAAPRYEKAANETGGNTGTGKKSVEAVAKEVLAGKWGNGEDRKKRLQAAGYDYGAVQAKVNELVKGSGKKSVDAVAKEVIAGKWGNGANRKKKLQAAGYDYGAVQKRVNEMLKK

SEQ ID NO: 2775 - protein, 253 aa, unidentified
  REGION 1..253: note = Ruminococcus sp. 210702-SL.1.03
MRGIDISQFQGNVNFSKVKKSGIEFVMIRAGFGRYESQRDPYFERNYKAAKAAGLHVGAYWYSYAQSVDDAKQEAKVCMKIIKGKQFDFPIFFDLEERSQFAKGRNHCDGLVKAFCGELEKNGWFAGLYISRSPLQTYISPTVAKRYALWVAEYGSRCNYGGSYGIWQYSSTGRVSGISGNVDLDVSTVDYPTVICKGGFNGYAKGSDKKSVDTLAREVLSGKWGNGAERKKRLTAAGYDYAKVQKRVNELLR

SEQ ID NO: 2776 - protein, 315 aa, unidentified
  REGION 1..315: note = Jutongia huaianensis
MSQRFGIDVSRWQGSFDFARAKSKEGVEFAIIKAGGADSGLYKDSQFEANYKKCVECGLPKGAYFYGNARSTAEAKKEAGYFLSLLKGKKFEYPVFYDVEGSMITKNDRNTLTQIIKAFCSEVEAAGYWVGIYSSESFFNSEMNDVELTRYTHWVARWGKSKPSPASGAETQIWQFGGETNLIRSNKINGQTCDQDYCYVDFPAKIKAAGLNGYAKGNSSAPAKKSNEEIAAEVIAGKWGNGTERQNRLSQAGYDYSAIQSIVNKKLSPSKKSVDEIAREVIHGDWGNGTERKNRISAAGYDYSAVQKRVNELLG

SEQ ID NO: 2777 - protein, 165 aa, unidentified
  REGION 1..165: note = Mediterraneibacter gnavus
MYNWDCQAQPNDGYSDHIGYVESVSGQMITVMEGNYNEAVARRQIPVGWGQIRGYARPKYTEGVTGRPSKSIEEVAGEVIQGKYANGEERRKKLCDMGYDPDAVQREVNRQLSQNEAPAEYYVVQENDTLSEVAKRFATTYLELAAWNGIADPNMIYVGQKIRIR

SEQ ID NO: 2778 - protein, 375 aa, unidentified
  REGION 1..375: note = Romboutsia ilealis
MSYKGIDVSHYDGNINWRIVKEHIDFAILRLGWIGNTHHELDTKFEIYYNECKREGIPIGIYVYNYCNTPETAKIGANWAVNHLKGKHIDLPVYIDMEDISIEHLGRKTLTDICIAFNKVIQDAGYWAGVYANLNWYTNYLNKDIIKERYTTWIADYGVSEDRFEGQYDMLQYSETGRVPGISSNVDMNIMYRDLINEIKGSGTDPDPDPGTDKKTIEELAKEVIAGQWGSGEERKTRLTNAGYDYEAVQAKVNEILQSTDRKTVEELAKEVIAGQWGNGEERKTRLTNAGYDYAAVQAKVNEMLEENTSTTNYYKAVSSTYNSIVEALNSIGVDSSFNNRKQIAIKNGINDYTGTAEQNIELLNKLKDGKLIEI

SEQ ID NO: 2779 - protein, 307 aa, unidentified
  REGION 1..307: note = Romboutsia ilealis
MSYKGIDVSHYDGNINWRIVKEHIDFAILRLGWIGNTHHELDTKFEIYYNECKREGIPIGIYVYNYCNTPETAKIGANWAVNHLKGKHIDLPVYIDMEDISIEHLGRKTLTDICIAFNKVIQDAGYWAGVYANLNWYTNYLNKDIIKERYTTWIADYGVSEDRFEGQYDMLQYSETGRVPGISSNVDMNIMYRDLINEIKGSGTDPDPDPGTDKKTIEELAKEVIAGQWGSGEERKTRLTNAGYDYEAVQAKVNEILGSTDRKTVEELAKEVIAGQWGNGEERKTRLTNAGYDYEAVQAKVNEILEE

SEQ ID NO: 2780 - protein, 153 aa, unidentified
  REGION 1..153: note = Romboutsia ilealis
EVIAGQWGNGEERKTRLTNAGYDYEAVQAKVNEILQSTDRKTVEELAKEVIAGQWGNGEERKTRLTNAGYDYAAVQAKVNEMLEENTSTTNYYKAVSSTYNSIVEALNSIGVDSSFNNRKQIAIKNGINDYTGTAEQNIELLNKLKDGKLIEI

SEQ ID NO: 2781 - protein, 423 aa, unidentified
  REGION 1..423: note = Romboutsia sp.
MSYKGIDVSHYDGNINWRIVKEHIDFAILRLGWIGNTHHELDTKFEIYYNECKREGIPIGIYVYNYCNTPETAKIGANWAVNHLKGKHIDLPVYIDMEDISIEHLGRKTLTDICIAFNKVIQDAGYWAGVYANLNWYTNYLNKDIIKERYTTWIADYGVSEDRFEGQYDMLQYSETGRVPGISSNVDMNIMYRDLINEIKGSATDPDPDPGTDKKTIEELAKEVIAGQWGSGEERKTRLTNAGYDYEAVQAKVNEILGSTDRKTVEELAKEVIAGQWGNGEERKTRLTNAGYDYEAVQAKVNEILQSTDRKTVEELAKEVIAGQWGNGEERKTRLTNAGYDYAAVQAKVNEMLEENTSTTNYYPPVSSTYNSIVEALNSIGVDSSFNNRKQIAIKNGINDYTGTAEQNIELLNKLKAGRLIKV

SEQ ID NO: 2782 - protein, 285 aa, Ruminococcus sp.
MSYTNSKLISYTKISPNRNINRNHKIDTVSIHCVVGQCSVETLGSIFASRDKEASSNYGIGYDGRIGMYVEEKDRSWCTSSASNDNRAITIEVASDTYHPYRVNDAAYKSLIKLLVDICKRNGIKRLVWSTNKSERMNHLNGCNMTVHRDYANKSCPGDYLYNLHGQIAKEVNAQLGLGSSKPATSKKTLYRVRKSWKDAKSQKGAFYDLSNAKKCADKNSGYSVFNESGKVVYTLKSSGKKSVDAIAREVIQGKWGNGADRKNRLTKAGYDYNAIQKRVNEILS

SEQ ID NO: 2783 - protein, 302 aa, Ruminococcus callidus
MAILRPDTSTTLNGVKINEYLLTRHNPNRIAMPSVSMEGKVIGVTVHNTDWISVASGTTPAEQYTRATVNGNMKDVRVHYYVDNTCAWQNLPLSLSGWHATDGSGNGNRRTIAIECIMSSAYNATDKKSEDNCARLAAALLKKYNLGIDHLYTHTHWLNVRDGKSGSVDYLNTARNSYKMCPLYILPHWSKFKKKVQGYMSSAVTPAPATKQLYRVRKTWTDAKSQIGAFSSLENAKKVCKNGYAVFDSNGKQVYPAKKSVDEVAREVIQGKWGNGAERKKRLTDAGYDYNEVQKRVNELLK

SEQ ID NO: 2784 - protein, 285 aa, Ruminococcus bromii
MSYTNSKLVSYTKISPNRNINRNHKIDTVSIHCVVGQCSVETLGSIFASRGKEASSNYGIGYDGRIGMYVEEKDRSWCTSSASNDNRAITIEVASDTYHPYRVNDVAYKSLIKLLVDICKRNGIKRLVWSTNKSERMNHLNGCNMTVHRDYANKSCPGDYLYNLHGQIAKEVNAQLDLGSSKPVTSKKTLYRVRKSWKDAKSQKGAFYDLSNAKKCADKNNGYSVFDESGKVVYTLKSSGKKSVDAIAREVIQGKWGNGADRKNRLTKAGYDYNAIQKRVNEILS

SEQ ID NO: 2785 - protein, 135 aa, unidentified
  REGION 1..135: note = Romboutsia ilealis
NAGYDYEAVQAKVNEILQSTDRKTVEELAKEVIAGQWGNGEERKTRLTNAGYDYAAVQAKVNEMLEENTSTTNYYKAVSSTYNSIVEALNSIGVDSSFNNRKQIAIKNGINDYTGTAEQNIELLNKLKDGKLIEI

SEQ ID NO: 2786 - protein, 474 aa, unidentified
  REGION 1..474: note = uncultured Schaedlerella sp.
MRLVESIMTRNPCYAAGRKITVKGLMLHSVGCPQPKASAFINSWNSPTHDTSCVHGFIDGNDGTVYQTLPWNHRGWHCGSGNKGSGNNTHIGMEMCEPACIRYTAGSNFTCSDMATAKAVAKRTYEAAVELFAMLCKKYSLDPLADGVIISHREGHSRGIASNHGDPEHLWAQLDMGYTMDGFRKAVKAAMGGAASGGSGTDGYTKIMGSAVATAEQMKNYIKAKNPKVAQSVLDMVPLYLSEGGMEGVRGDIAFAQSCLETGNFTFSGSAVTLSQNNFCGMGVTSNGMKGNSFGTPQLGIRAQVQHLKAYASTDALKNACIDPRFRYVTRGCAEYAEWLGQKENPDGKGWASGAGYGEKVLAILKGILGTSVTPTETWYRVRKTWADATSQKGAFKVLENAKKCADVNLGYSVFDGEGSKIYPADSSAKKSVDAVAREVIQGKWDNGAERKQRLTAVGYDYSIVQKRVNELLK

SEQ ID NO: 2787 - protein, 307 aa, unidentified
  REGION 1..307: note = uncultured Solibaculum sp.
MNVVKIEMPQSMYKYKCPHAMTPTRIVVHNTANDASARNEIKYMQSNNKQVSFHIAVDDQEAVQGIPLDRNAWHAGDGANGTGNRYGIAIEICYSKSGGSRFEAAERNAAQLIAQMLKARGWGIDKVTKHQDYSGKYCPHRTLDMGWQRFLDMVKANMSGGSSGGNTYTVQYGDTLSGIAKELLGDASRYKEIAALNGIDNPNVIKVGQVLKIPGGCSGGSTPTQPSKSVDEIAREVIVGKWGNGSERKDRLTAAGYDYAAVQARVNELMGGSSSGSVSSAIAVGDTVRITCNAYSTGQAIPSWVKN

SEQ ID NO: 2788 - protein, 375 aa, unidentified
  REGION 1..375: note = Mediterraneibacter gnavus
MDYHNYFGLKCGTKWQGKSVNLATWEEYEAGTAMVISDYFRVFDNMEEGVKGYFELLQLPRYQNLKGITEPGRYLETIWADGYATSSVYVQKNMELIEQYQLMKYDENASGRSAQDVLNVMRSWIGYSEANGKFRQIIDLYNSYLPLARGYAVQYTDEWCDTAVSAAAIQAGCVDLIGTECGCEKHIEIFKEKGIWIEDGTIVPLPGDIILYNWDCQVQPNDGYSDHIGYVESVSGQMITVIEGNYNEAVARRQIPVGWGQIRGYARPKYAEGVTGQPSKSIEEVAGEVIQGKYANGEERRKKLCDMGYDPDAVQREVNRQLSQNEAPAEYYVVQENDTLSEIAKRFATTYLELAAWNGIADPNMIYVGQKIRIR

SEQ ID NO: 2789 - protein, 285 aa, Ruminococcus sp.
MSYTNSKLVSYTKISPNRNINRNHKIDTVSIHCVVGQCSVETLGSIFASRDKEASSNYGIGYDGRIGMYVEEKDRSWCTSSASNDNRAITIEVASDTYHPYRVNDAAYKSLIKLLVDICKRNGIKRLVWSTNKSERMNHLNGCNMTVHRDYANKSCPGDYLYNLHGQIAKEVNAQLGLGSSKPATSKKTLYRVRKSWKDAKSQKGAFYDLSNAKKCADKNSGYSVFNESGKVVYTLKSSGKKSVDAIAREVIQGKWGNGADRKNRLTKAGYDYNAIQKRVNEILS

SEQ ID NO: 2790 - protein, 346 aa, unidentified
  REGION 1..346: note = Bacteriophage sp.
MKKIIDISEHNGDINWSIAKKEIDGAILRVGYGHSTLDKYFEKNTTEARKANVSIPAVYHFSYALTPEDARIEAEFVIKHLNRLNYDKNTIVYFDYEDDSIRYSKSKGVTPKVTDVISMGQLFVNTIRKAGYKAGIYANSEYYNKWFNKFINFSDIYFWYADWRKTPDNKLVSICDIHQHSSSGGVGGIKTRVDMNNWYDDRKKTVSEESKSTVSSLLKSNEEIAKEVIDGKWGNGNERRAKLISAGYDYDTIQKIVNESLSAPDKVASAKSKDNQLTGTYEVAVNAVNVRYVPGVITEKNVVALAYNGNTLQCYGYYTMVGNKKWLLIQFGDETGFVDSQFVRRK

SEQ ID NO: 2791 - protein, 369 aa, unidentified
  REGION 1..369: note = Caudoviricetes sp.
MLLIKRENKNLKRQVNNKKGENTVKKLIDISEHNGDINWSVTKKEVDGVILRVGYGQSTLDKCFEKNTTEARKSNVPIPAVYHFSYALTPEDARIEADFVVKQLNNLSYDKNTVVYFDYEDDSIRYSKSKGVTPKVTDVISMGQLFVNAIRKAGFKAGIYANSEYYNKWFNKFINFSDIYFWYADWRKTPDNKLVSMCDIHQYSSSGDVGGIKTRVDMNNWYDDRKKTVSEESKSTVSPILKSNEEIAKEVIDGKWGNGNERRTKLISAGYDYDTIQKIVNEKVNTPSKVASAKSKDNQLTGAYEVAVNAVNVRYIPGVITEKNVVTLAYNGDALQCYGYYTMVGNKKWLLIQFGDKTGFVDSQFVRRK

SEQ ID NO: 2792 - protein, 198 aa, unidentified
  REGION 1..198: note = Caudoviricetes sp.
MQVNDFIKKALEVEKMPTLYKLGKFMNSYHQGKNNKYLLCDCSGLIKGILWGYPQDGIYGNNGVPDINANTMITYYCSDVSSDFSNIEKGELVWLEGHIGIYVGNNNVCECSPKWENGIQITKLSQRKWKKHGKFKYIDYSTSNNHINNSTRVDINKVVDDVINGKYGNGHDNRRKKIEALGLNYEEVRRLVNQKLKG

SEQ ID NO: 2793 - protein, 265 aa, unidentified
  REGION 1..265: note = Streptococcus equi subsp. zooepidemicus
MVVDTEKAIAWMGLKEGHVSYSMDYRNGPDSYDCSSAICSALIYAGASNPGWLLNTEYMHDWLIANGYVLIAENEDWESQRADIAIWGLRGQSAGAGGHVVMFIDADNIIHCNYARNNITIDNYNQTAAASGWMYSYVYRYAGTQSQPATSKSVDELVQEVLAGLHGSGEQRKISLGANYDAVQTKVNELLKQPKVAEQSPAVKQDGDLLFNGAVLKKSVLDTILTKCKEHDILPSYAITVLHFEGLWGQSTVGRTDNNWGGMTW

SEQ ID NO: 2794 - protein, 465 aa, Streptococcus suis
MVINLETSIRWMNDRVGKVTYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDVRKASLGNQYEAVMAVINGKATAPKKTVDQLAQEVVAGKHGNGEARKKSLGNQYEAVQKRVTELLKKQLSEPSKAQEVKQPTETKTSQIEPTGQATVSKEEGDLSFNGAILKKVVLDKILANCKKQDILPSYAITVLHFEGLWGTSAVGKVDNNWGGMTWTGKGERPSGVTVTKGSARPSNEGGHYMHYATVDDFLTDWFYLLRAGGSYKVSGAKTFSDAVKGMFKVGGAAYDYAASGFDSYIVGASSRLKAIESENGSLDKFDKQTVTDVGQSDKIEVTIEGIEISINGVTYTLSKKPI

SEQ ID NO: 2795 - protein, 255 aa, unidentified
  REGION 1..255: note = Bacteroidales bacterium
MAKKNNDRFELNKGGGRKFDLDKGTGKHRFDLSKDDELIDEENVSADAPEQMEPVAPVNPPQPEEPASVQQPDLSKEATDRAIEYDPEEPKKKGFAWLWALIGIAIVLAFLGMLFLNRGEKEEDKQIGDVEAVISSADDSASVDSTPVIGSDENAAAQENASEETPVNNSGNATSNEETQAAASTESTPAAKIPSTPASANAPAPASDVNGEVEAEALKVIHGDYGDGDVRKDRLGSRYNEIQSRVNQLKRSGRF

SEQ ID NO: 2796 - protein, 251 aa, unidentified
  REGION 1..251: note = bacterium
MANNKGNFNFEKGGDKSQPENSANKKINLSKSEEENLINELSESNSDGKPVAPLNPPQPEEPASVQQPDLSKEATDRAIEYGPEEPKKKGFAWLWALIGIAIVLAFLGMLFLNRGEKEEDKQIGDVEAVISSADDSASVDSTPVIGSDENAAPQENTSEETPVNNSGNATSNDETQAAASTERTPAAKIPSTPAAANTPAPASDVNGEVEAEALKVIHGDYGDGDVRKDRLGSRYNEIQSRVNQLKRSGRF

SEQ ID NO: 2797 - protein, 632 aa, unidentified
  REGION 1..632: note = Bacteroidales bacterium
MKEGKVRNPIAWVPSVYFAMGMPFVALSLVSVIMFKDLGIDEASITLWTSLIILPYSLKPIWSPLLEIWGTKKGVVVITQMLSGLCFGFIAFMLPIPNFFAFTIAMMGVIAFSGATHDIATDGIYLTSLDKDTQARYIGWQGAFFNLAKVLANGGMVGLAGILMDHFKETEPEKAAMYAWMIIMGLIAILLCALSIYHYFVLPKGAKSADAPTSAYRAMVSFAEVFKAFFQKKYIWIFILFIVSYRLTEGFAVKMVPLFLKASLEEGGLALSNGQIGLIYGTLGTIAFIIGSIAGGYYIAAGKLKRVLFSLICIFNIPFVIYYLFALFQPANIYLIGSGLVLEYFCYGFGFVGLTMFMMEQVAPGKHTMAHYAFASGIMNLGFMIPGMISGWIFQQVGYEQFFFIALVVSIPAFIMAWVVPFDNAQLSKIKMLCSKIIGAVVVGAVIFVIYLLLNPTNANMSGRITAESTNENLKEINVRVVGTTFSTTTNEEGCYSFENLPVGEFNVEVTKENYATQTLKVNIVEDSTYVVNFVLEELSEAEPLKEASENIEPVLNEQKEEVSDTTSKNDSTPPANELEYKALSVIRGDFGNGEERKEKLGVDYQVIQNEVNKMYKNDFYIKKYKIRNKIY

SEQ ID NO: 2798 - protein, 198 aa, unidentified
  REGION 1..198: note = Paludibacteraceae bacterium
MVTLKKKVTLKTKVAETVTTNTTPETPKNKPSNNGRKFWVAILLIVVAIVAFLLLKPENGEKSSLDASNETVVQQNEVSPKQEAEQPASEAASNENEEETVTEENNSNKENAEEYDNSSTVEEKSQVTQQPTSQPVTKKVLNIQSTDINLSLSTVEEKARLVIRGDFGNGKERKMKLGSEYSVIQNKVNEMYAKGIVH

SEQ ID NO: 2799 - protein, 480 aa, unidentified
  REGION 1..480: note = Bacteroidales bacterium
VYDTKYKENRAACEALGIPFSLYVFPTSITDAEAIEEADFIIQEAKGMKFVLPIFLDSEYAEGSGKGRSDQLNRADRTHFLRIICERLQANGIPAGVYASTSWIKNRLDASQLPFSWWVAQWASKLSYSGDWLIWQYTSKGSVPGISGNVDCSQRNTSKPVTVPETEVKGVTAEDVLAVMRSWIGLSRSAGTHHVIIDTYNSYTPRARGYKVSYSDAFCDTTVSAAFIKLGAVDLIGGPECGVEEHVKLFQKAGIWEEDGTVTPEPGWLIVYNWDDSTQPNDGFSDHIGIVEKVSGGMITAIEGNISGGVVGRTTRKIGHGNIRGYAKPKYGMSSGSARKSVEELAKEVLAGVWGNGDDRKARLTAAGYDYNAVQARVNQLVAAPEPAKTTVDELAKEVLAGSWGNGQERKDRLTAAGYDYNAVQKKVNALVSGSSKSIDELAQEVIAGKWGNGSDRKARLTAAGYDYARVQAKVNKLLS

SEQ ID NO: 2800 - protein, 294 aa, unidentified
  REGION 1..294: note = Clostridia bacterium
MSEFLKANRVRLERGIIVHEKFLPPALKPNRQMTSVTPQYVTIHNTSDIKEAEGTNDAEQYARATHNVAMGGVSVHYYIDESDCWQLLREDEMGFHAADGYGPGNGTSIAIEIIMDGSGSKADVEAEERGAILAASLLKRHGLDIDCLTTHNHWYPKKYCPAYILPHWDKFVDKVGGYLGLPEGLSDDAVADQVIAGRWGSGEERKRKLVFAGYEYDSVQSIVTKKMKALTRVMGDLDDDGKVTAADARLALRAAVDLELLDEEQIARADVDKDGKITAADARMILRMAVGLDG

SEQ ID NO: 2801 - protein, 205 aa, unidentified
  REGION 1..205: note = Methanobrevibacter sp.
MWKQVRLFDLDDMGHEKGYCLRNVRLAFRIKAKFASAIEDYKNNLKKGTIHQISTLPLNVAVPVYLDTANKYDHIVVADKGIFYEDGKRMYLTPNLKFYGWGELINDVRVVEWIPDKSNYEIALEVIEGKWGNGNDRIRRLAQAGYNYYDIQKIVNELVSKKSNKEIAKEVIKGKWGNGEERKKRLTEAGYNYNEIQKIVNELLK

SEQ ID NO: 2802 - protein, 63 aa, unidentified
  REGION 1..63: note = Bacteroidales bacterium
MTLPPLANELEYKALSVIRGDFGNGEERKEKLGVDYQVIQNEVNKMYKNDFYIKKYKIRNKIY

SEQ ID NO: 2803 - protein, 190 aa, unidentified
  REGION 1..190: note = Bacteroidales bacterium
MAEEKKNTKKDGSEKPKPQDQQNANASDNNQQPIPEPLVEEAITPNRSYWWLWVILAVIVIGFIWWWVCLPSANSEEVIVPINNETPDGAVTAPTADPLYVPAEGTEDESQANPEDGDKAAAAIPTGKAARGLKAGGNAASAQASNADIDVLAKKTIKGNYGNGKVRKQKLGDKYPRVQARVNQMMRRHK

SEQ ID NO: 2804 - protein, 216 aa, unidentified
  REGION 1..216: note = Muribaculaceae bacterium
MKTLNDNPSSGNPLPTDKEFYDQDFNTTLQAEMFDNGPETEDERLGDRALKGAAWLAGIVGLFALAIVIAAAFDLSPTPSPAKPHQARTAMQQAYISSPGSASSAAAYTNYASSQSLFNTKPVILKSITVIGLEPSNPANAAAKVAASPAKMAAKASVAKPQANPAASMSKADMDRIEKEALEVIHGDYGNNPGRAQKLGADYDLVQARVNQLLHS

SEQ ID NO: 2805 - protein, 213 aa, unidentified
  REGION 1..213: note = Muribaculaceae bacterium
MKTLNENPSSSNPMPTDKEFYDQEFNTDLQAEMFDNGPETEGERLGDRAMKGAAWLAGIVGLFALAVVIAAAFDLSPTPSPAKATKTRTTALRTNIGTPGSSATDYSSSYASTQPIVLKSITVIAQEPAKFAQNAASAGASATTKTAEKAVSAATPADKASAATGMSKADLDRIEREALEVIHGDYGNNPGRAKKLGADYDLVQARVNQLLHS

SEQ ID NO: 2806 - protein, 421 aa, Streptococcus suis
MHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLDQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2807 - protein, 134 aa, Nosocomiicoccus ampullae
MHATNSYQAFRRKVQRYLDQLNGKKVAKAKPKKVSKPKTMVKPKTIAQLADEVLAGKHGNGDARKRSLGSNYAKVQAEINRRFGVKSAPKKKSAATIVNEVIAGKWGNGRARFDKLWKAGYDPNVIQREVNKRY

SEQ ID NO: 2808 - protein, 200 aa, Bifidobacterium adolescentis
LGSLSGWSGRLDLNKFRGDRAAWRKYANPDDKGAADLPSVKPKPQPTTAPAVDLNALATRTIRGDFGNDPARRQALGGNYAAVMQIVNSRLGGGSDGTAATGSRSVVVRSGDTMCAIAERTGLKPVSAWRVPSGDINRIYPGQIVTYGGASVSTASSGVGGHVVRSGESLWSIYGSGWQSAAARNGIRSPYVIYPGQYLR

SEQ ID NO: 2809 - protein, 420 aa, unidentified
  REGION 1..420: note = Mediterraneibacter gnavus
MKKEEFIQKIAGYVKKYVAAYEIQVCSPIIAQAILESGWGESRLAKDYHNYFGLKCGTKWKGKSVNLATWEEYEAGTATVISDYFRVFDNMEDGVKGYFELLQLPRYQNLRGITEPEQYLEMIRADGYATSSTYVQKNMELIEEYQLTRYDENVSGRSAQDVLDVMRSWIGYSEANGKFRQIIDLYNSYQPLARGYAVQYTDEWCDTAVSAAAIQAGCVDLIGTECGCEKHIEIFKEKGIWIEDGTIVPLPGDNILYNWDCQVQPNDGYSDHIGYVESVSGQMITVMEGNYNETVARRQIPVGWGQIRGYARPKYTEGVTGRPSKSTEEIAKEVIRGKYGNGEERRKKLCDMGYDPDVVQKEVNRQLRQNETQAEYYVVQEKDTLSEIAKRFGTTYQELAARNKIADPNRICVGQKIRVW

SEQ ID NO: 2810 - protein, 176 aa, unidentified
  REGION 1..176: note = Phocaeicola
MADNKIFTEADFDKEPHTSNKKFGYKNPWLIVGVIVLLCIIGYFFLSKFDNGSQKPVIVKDKTGVENISVPSDTTNSGETVKEEAGDVESELAEKSNSNANETATSVESTKPTETATTVTTNTYIKTFDVSNDVETEAIKVIRGDYGVGQERKNKLGEKYQTIQNRVNELKRKGLF

SEQ ID NO: 2811 - protein, 273 aa, unidentified
  REGION 1..273: note = Nosocomiicoccus massiliensis
MAYEIVDMYLPSSKYPIKAPYAMKPEYVTVHNTGNTASARNEATYHNNNNNQVSYHVAIDDKEAIQLIPFNRNSWHAGDGANGTGNRKSIGIEICYSMDNGYSGAKSARYKKAEDNAALYIAHVLKQYGWGIDRLKRHYDWSGKDCPHKMHATNSYQAFRRKVQRYLDQLNGKKVTKAKSKSKTISQLADEVLAGKHGNGDARKRSLGSNYAKVQAEINRRFGVKSAPKKKSTATIVNDVLAGKWGNGQDRFNRLKRAGYDPNVIQREVNKRY

SEQ ID NO: 2812 - protein, 426 aa, Streptococcus suis
VNTEYMHDWLIRNGYVLVAENKPFNAQRHDVCILGKRGYSSGAGGHVVIFVDNANVIHCNYARNGITIDNYNQVHRGMYYYLYRPANQPSISNKSLDQLVKETLAGVHGNGDARKASLGNQYEPVMAVINGKATAPKKTVDQLDQEVIAGKHGNGEARKQSLGADYPAVQKRVTEILKSDTSGNAPKTPLDTPKIGVVNSSAEPKTEETGATGKATDTKITKEDGDLSFNGAILKKSVLDVILAKCKEHNILPSYAISVLHFEGLWGTSAVGKADNNWGGMTMTSNDLQITRPSGVIVTRGLARPSNEGGHYMHYASVDDFLTDWFYLLRAGGSYKVSGAKTFLEAVKGMFKVGGAVYDYAATSYENYLVGMSSRLTAIESENGSLAKYDQQTVTDVAKIDKIEVAIEGIEVTINGTRYRLTKEPI

SEQ ID NO: 2813 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKVTAPKKTVDQLAQEVIAGKHGNGEARKQSLGADYPEVQKRVSELLKKQPSESSKSPEVKQVTETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIEAENGSLAKYDQQTVTDVGSSDKIEVNIEGIEISINGVTYTLSKKPV

SEQ ID NO: 2814 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKVTAPKKTVDQLAQEVIAGKHGNGEARKQSLGADYPEVQKRVSELLKKQPSESSKSPEVKQVTETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIEQENGSLAKYDIATVTDVAKTDKIEVAIEGIEVTINGTRYRLTKEPI

SEQ ID NO: 2815 - protein, 468 aa, Streptococcus suis
MTINLETSIRWMSDRIGKVSYSMDYRNGPNSYDCSSAVYYALMSAGAISAGWAVNTEYMHDWLIRNGYVLVAENKPFNAQRHDIFIWGKRGYSSGEGGHTGIFVDNVNIVHCNFKRNGITIDDYNKVSRGMYYYLYRPANQPSISNKSLDQLVKETLAGVHGNGDARKASLGNQYEPVMAVINGKATAPKKTVEQLAQEVIAGKHGNGEARKQSLGADYPAVQKRVTELLKKQPSEPLNGQEVKQVAETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRSGGSYKVSGAKTFSEAVKGMFKVGGAVYDYAATGYENYLVGMSSRLKAIESENGSLAKYDQQTVTDVGSSDKIEVNIEGIEISINGVTYTLSKNPV

SEQ ID NO: 2816 - protein, 409 aa, Bifidobacterium adolescentis
MNPRRQWRKLLTALAVAISMAVAPAAMADMNGYDISNWQCGIDTATVPADFVIVGTTWGSGGVYGGCLSNGVNTDANRQLAGAINSGKETGVYHYARGGNPETEARFFVDNVRGYVHKSVLVLDWEAQDNAAWGDKQWPRRWAREVKRLTGVNPIIYTMDSGYWQVAGMETELNCGIWIAQYATNMVTGYQTAPWNIGARGEVMRQYTSNGSLNGWSGRLDLNKFRGDRAAWRKYANPDDKGTANLPSVKPTPQPTTAPTVDLNALATRTIRGDFGNDPARRQALGGNYAAVMQIVNSRLGGGSGGTAATGSRSVVVRSGDTMCAIAERTGLKPVSAWRVPSGDVNRIYPGQIVTYGGASVSIASSGVGGHVVRSGESLWSIYGSGWQSAAARNGIRSPYVIYPGQYLR

SEQ ID NO: 2817 - protein, 470 aa, Streptococcus iniae
MTINTEQAIAWMSVRQGKVSYSMDYRDGPTSYDCSSSVYYALRSAGASSAGWAVNTEYMHDWLIKNGYELIAENVDWEAKRNDIAIWGERGYSSGAGGHVVMFIDADNIIHCNWARNGITIDNYNATAAASGWMYCYVYRLKGGETSSTSEKSLDTLVKETLAGTYGNGDQRKAALGNQYEAVMAVINGKATTSQKTVDELAQEVIAGKHGNGETRKKSLGNQYETVQKRVTELLKKQSSEPSNAQEVKQPTETKTSKTEPTGKATVSKEDGDLSFNGAILKKSVLDNILANCKKHDILPSYALTILHYEGLWGTSAVGKTDNNWGGMTWTGQGQRPSGVTVTQGSARPSNEGGHYMHYASVDDFLTDWFYLLRSGGSYKVSGTKTFSEAVKGMFKTGGAVYDYAASGFDSYIVGASSRLKAIETENGSLDKFDKATDIGDGSKDKIDITIEGIEVTINGITYELTKKPV

SEQ ID NO: 2818 - protein, 512 aa, unidentified
  REGION 1..512: note = Petralouisia muris
MNLVESIMTNNPCYKKGQKITVKGLMLHSVGCPQPSASAFILSWNNESFDRACVHGFIDGNDGTVYQTLPWNHRGWHCGSSINGSANNTHIGIEMCEPGCITYTGGSAFKCSDTDTAKAVAKRTYEAAVELFAMLCRKYNLDPAVDGVIISHKEGHSRGIASNHGDPEHLWSQLGMGYTMDTFRKAVKEQMGGKAETKAETQAGVFAGLSEKDAVPIIGALCREDMKKSGILASVSAAQFILESGYGKSELGQNANNMFGMKRSLSGNSWGGSAWDGSSVYTKKTQEQNADGTYETVTADFRKYSCVEDSIADHSAYLLGAKNGKVLRYKGIKGMTDYKAVAQLIKDGGYATSLTYVEKLCSIIEKWNLTQYDVLGTPAPKPSTSDTATNFPAAPFTVKVLIDDLNYRSEPSMNGTVKGQTGKGVFTIMEVNDGWGRLKSGAGWIWLGNPSYCTVQDTVSETPKTSSAKSADEIAKEVIRGDWGNGQERKQKLTAAGYDYSAIQKKVNEMLN

SEQ ID NO: 2819 - protein, 516 aa, Acetivibrio ethanolgignens
MKLVESILTKNPCYTAGRKIDVKGLMLHSVGCSQPRASAFINSWNSPTFDRACVHGFIDGNDGTVYQTLPWNHRGWHCGSSINGSGNNTHIGVEMCEPACITYTGGATFKCSDLATAKTVAERTYKAAVELFAMLCKNFNLDPLADGVVISHREGHARGIASNHGDPEHLWSQLGLPYTMDTFRKAVKEQMGGKSDSKKGTQAIVFAGLLEKDAVPIIGELCREDMKKSGILASVSSAQFILESGYGKSELGQNANNMFGMKKSLSGNTWTGSTWDGTSVYTKKTQEQNADGSYETITADFRKYPCVEDSVADHSAYLLGAKNGKSLRYKGIKGMKDYRAVAQLIKDGGYATSLSYVDNLCNIIEKWNLTQYDTDSQTIPDDTPSNPDTVTSFPAIPFSVKVIIDNLNYRSEPSMNGKVNGQTGKGTFTIMEVQNGGWGRLKSGAGWIWLSNPTYCTVGKTVKTSTKKTSSTKSVDEIAKEVIRGDWGNGTERKEKLTAAGYDYATIQKRVNEMLK

SEQ ID NO: 2820 - protein, 618 aa, Bifidobacterium adolescentis
MAAQDIGVAYVHVEPSGKGFGKSIEGDIGDAVNKASKKSSSTLISKIGGAFGKIGKVGAGAIATLAGGITVLAAKGGFTRALNIENAQAKLKGLGHDSASVTEIMNDALASVKGTAFGLGDAATVAASLSASGIKEGGDLTKVLKTVADTAQISGRSLTDIGTIFGSVAARGKLQGDDMLQLMSSGIPVLQMLGKHLNKTSAEVSDMVSDGKIDFQTFADAMKEGLGGAALSAGTTFTGALANVKAALSRLGETAATPVLDGLRGLFNQAIPLIDTFTAAVTPTLQKVGAALQQGLENAIPATQAKLKNLGDTISNIPGFQMLASATASLKSQLTGLWNAITSLIGGLNNGGEAATMFSTTAGALAGMDSGYWQVAGMETELNCGIWIAQYATNMVTGYQTAPWNIGARGEVMRQYTSNGSLSGWSGRLDLNKFRGDRAAWRKYANPDDKGAADLPSVKPKPQPTTAPTVDLNALAARTIRGDFGNDPARRQALGGNYAAVMQIVNSRLGGGSGGTAATGSRSVVVRSGDTMSAIAARTGLQPVSAWRVPSGDVNRIYPGQTVTYGGASASTASSVVGGHVVRSGESLWSIYGSGWQSAAARNGIRSPYVIYPGQYLR

SEQ ID NO: 2821 - protein, 427 aa, unidentified
  REGION 1..427: note = Blautia sp. MSJ-36
MRIAREKFIADIAGYVKKYADLYGILVYSPVIAQAVLESGWGESRLASQYHNYFGLKCGTRWNGRSVNMRTQEEYREGTLTSIRDNFRVFDSMEEGVKGYFEFIQLERYRNLQGIRDPQEYLETIRADGYATSFSYVENCMKVIRQYELTRFDEGGCETMAKTAESILDVMRGWLGFSEANGKFKEIIDLYNSVKPLPRGYAVQYSDEWCDTCVSAAGIKAGCSELIGRECGVEEHVKIFKKMGIWIEDGTITPEPGYVIVYNWDKAAQPNDGYSDHIGFVEKVSGGMITAIEGNRGEKVDRRVIPLGWGFIRGYAAPRYAKAVNGTGGNPGTGKKSVEAVAKEALAGKWGNGEDRKKRLQAAGYDYPAVQAKVNELVKGSNKKSVEAVAKEVIAGKWGNGEDRKKRLQAAGYDYGAVQRKVNALMR

SEQ ID NO: 2822 - protein, 134 aa, Nosocomiicoccus ampullae; identical to SEQ ID NO: 2807

SEQ ID NO: 2823 - protein, 95 aa, Nosocomiicoccus ampullae
MVKPKTIAQLADEVLAGKHGNGDARKRSLGSNYAKVQAEINRRFGVKSAPKKKSAATIVNEVIAGKWGNGRARFDKLWKAGYDPNVIQREVNKRY

SEQ ID NO: 2824 - protein, 146 aa, Bacteroides sp.
MIRPDYRDFRIRPQFLRHSSEGSSWNKHKYIKRVDGTYYYPDSYEGGRHLPDGEKTESNSKIDLSENDVEKLAKEVISGNFGIGQERKDLLGENYEEIQKRVNELMKGSVGLKTIPSDKTKAMDIAEEAAKRAIALVNADRNKKTK

SEQ ID NO: 2825 - protein, 214 aa, unidentified
  REGION 1..214: note = Prevotella pectinovora
MNKSKKLFNSEDFDKKQPLFEPEDFDKSVKKNQKDEKGQVPVSENDSSSPHPVEKSSKAKIIGGIVAAALIIAGGIFFANNDKANDCGSNKPTTETIAQEGGKHDVDSNDSTTELNGKTEAKTSADAEGKPSANGDNPKPYAADESHVTTSTGKSPTSPSEKSDNNVDGDVETNARRVIRGDFGNGQERKDKLGSSYSEIQGKVNEMYRQGIVN

SEQ ID NO: 2826 - protein, 303 aa, Streptococcus suis
ARKASLGNQYKPVMAVINGKATAAKKSIDELVQEVIAGKHGNGEARKQSLGADYPVVQKRVTELLKKQPSEPSKGVEVKQPSDTKISQTEPPGQATVSKEEGDLSFNGAILKKSVLDVILAKCKEHNILPSYAITVLHFEGLWGTSAVGKADNNWGGMTMTSNDLQITRPSGVIVTRGLARPSDEGGYYMHYASVDDFLTDWFYLLRAGGSYKVSGAKTFSEAVQGMFKVGGAVYDYAASGFDSYIVGASSRLKAIESENGALSKYDTATVTDVVSTDKIEVNIEGIEISINGVIYELTKKPV

SEQ ID NO: 2827 - protein, 325 aa, unidentified
  REGION 1..325: note = Caudoviricetes sp.
MKLFVICGHGAGDPGACANGYEEAERVRVLGKKIKELGGSNVTLGDVNRDYYADNGISSLNLSKDTQIIELHMDSASASARGAHIIIWHEFQPDDYDNALASFLCGLFPGRSTKIAKRSDLANPARAAAKGYGYRLAECGFISNKEDLEIFNNNIEKIAKGILEAFGISASGASSSNKPSAGKPSSGSSSSSKKTISQIAKEVINGEWGNGDARKKKLAAAGYDYDAVQKEVNKQLGVSTSAGSGNASSKKKTVTLPASASSWRVYPTNKAPVVGNECGYLYPSKFGGLTYDILATPQTDVVTIKTRDYGKVNIYVAKSTGAIIK

SEQ ID NO: 2828 - protein, 319 aa, unidentified
  REGION 1..319: note = Caudoviricetes sp.
MAMNGIDISSWQRDINLSAIKADFVIVKATEGIGYVDKSCDMLFQKALSLGKKLVFYHFARPTKNNDRIREADFFYENCKGYFGKAIPILDWEAENKQNVAYAKAWLDRVYQRSGVKPVIYMSESVVNAYDWSSVANADYGLWVAKYRDNATDYNYNMANAGSRPHVKWWKFYCMWQWTSSGRLDGYGSNLDCNVFYGDAATWDKYVGKSTGTAKPQSKPVAKTVDQLAEEVIAGQWGNGSERKKRLTAAGYDYNAVQQMVNRRMAAKKQPAYVYYVVKRGDTLSAIASKYGTTYQKLAQMNGIANPNKIYAGQKIRVK

SEQ ID NO: 2829 - protein, 522 aa, unidentified
  REGION 1..522: note = Caudoviricetes sp.
MKGIDVSYWQDSINWEKVKADGVQFAVLREGYRNTIDKKFVENVQGCQKNGMTVMVYHFIYTDNATTVENAKATVKNMKAAGLDISKTWIFADLEYDTWKRNGEKCTREKCSLYTLEYIRELEKLGCKRIGVYMNCDYYKNYYTDEIKNNYKIWLADYNGGADFSCSIQQTTSSGKVSGISGNVDMNTLFDTGMLSSETTKEDNKTMGYDRAKVVSQAQSWIGCKESDGSHKKIIDLYNTQNPRPRGYKVQYTDAWCATFVSAVAVKLGYTRIIPTECSCNYMIKGFQNIGCWEENDAYVPNPGDVIFYDWQDSGIGDNVGSSDHVGIVEKCDGKTITVIEGNISNKVGRRTLAVNGKYIRGFGVPAYTSNSVPSTSGSSNKKSLDEIAREVVQGLWGNGDDRKNRLVAAGYDYNAVQSIVNSLASSSSVSSNKKSVAEIAKEVLQGKWGNGDDRKKKLTAAGYDYSSVQAEVNKLCNKKSIDTIAREVIAGKWGNGDTRKKKLQAAGYNYSEVQKRVNQLL

SEQ ID NO: 2830 - protein, 247 aa, unidentified
  REGION 1..247: note = Caudoviricetes sp.
MSEKTTKFINTIGVLAKNEYLSRSRWVLPSVCIAQAALESGWNLKAKTLFGIKGQGFTATTSEFYNGHYVQIQDSFRAYPNVASAVVGYYDFITGTPRYAGVVNNSDYKSAVDKLIHTTDGLAYATSPDYIKNVISIIEKYGLTKWDERPQERKSSGELADEVIAGKWGNGSERESRIRAAGYDYAAVQAIVNSKLGVSKPNKKSVDEIAREVIHGDWGNGSDRKRRITNAGYDYAAVQKKVNELLR

SEQ ID NO: 2831 - protein, 107 aa, unidentified
  REGION 1..107: note = Rikenellaceae bacterium
GYKASVKNPEPKPIPTLTIEEAAKKVIAGEFSNGGNRKKAIEALGLSYKKVQTRVNQILRDSAKSVDQLAREVLAGKWGNGDDRKKRLTDAGYDYDAIQKKVNELLR

SEQ ID NO: 2832 - protein, 157 aa, Listeria monocytogenes
WFQDLTELDRLAPYDFWVAQWSSKEPTLRHGIWQYTSKGKLSGYSGNLDMNYAYKDYKAIIRSARLNHLGKEENAPAPTEKKSVELLAKEVIQGLWGNGEERKKRLTGAGYDYAMVQSKVNEMLSSKKSIDIIAKEVIRGDWGNGQERKNKLTKAGY

SEQ ID NO: 2833 - protein, 223 aa, Ruminococcus bromii
MTAESEYVEEKDRSWCTSSASNDNRAITIEVASDTYHPYRVNDVAYKSLIKLLVDICKRNGIKRLVWSTNKSDRMNHLNGCNMTVHRDYANKSCPGDYLYNLHGQIAKEVNAQLGLGSSKPATSKKTLYRVRKSWKNAKSQKGAFYDLSNAKKCADKNSGYSVFDESGKSVYTPKSSGKKSVDTIAREVIQGKWGNGADRKKRLTKAGYDYNTVQKRVNEILS

SEQ ID NO: 2834 - protein, 163 aa, unidentified
  REGION 1..163: note = Oscillospiraceae bacterium
MGAVACWRKGKAFNESDGCGHVAIVEEIKPNGDIVCSNSAYGGSRFYVKEYSKSAGYNYGALTFQGFILPPVDFEDSSVDELAREVIQRLTEIGCDWEDVQERVTELLDSAQSAPKKSVDEIAREVIRGDWGNGDERKKRLTEAGYDYYAVQNEVDKLLKLQR

SEQ ID NO: 2835 - protein, 248 aa, unidentified
  REGION 1..248: note = Erysipelotrichaceae bacterium
MALKDLFKKKDTTSSGVTAADLAALTGKKAEEVKEAAATTFKKAEEKAATTVQKAEEAAKTTAAAAKESINDTLQAAKAANAAAKVAAAKEAAALAEEAKKIEDLAKEVIQGKWGNGQERKDKLTAAGFDYDKIQAKVNELLGAVKPAGTKTVDDLAKEVIRGDWGNGQERIDKLTAAGYDYKAIQAKVNELMAPKPAAAPAAGKTIEEVAKEVIQGKWGNGQERKDKLTAAGYDYNTVQAKVNELLK

SEQ ID NO: 2836 - protein, 351 aa, unidentified
  REGION 1..351: note = bacterium
MAKTNHEIALEVIAGKWGNGVTRQEKLTKAGYNYDAIQKEVNNILSQPKLKSIDVVAQEVIDGKWGNGNDRKSKLIAAGYDYNKVQAKVNELLTPKKPALKSIEVIAQEVIEGKWGNGNEREAKLTKAGYDYNKVQAKVNELLAGKTPAVSTAKKVKGIDISTWQGNISKANFEKVKKSGIGFVILRLGFTGSATSKPTLDNTFENNYKNAIAAGLPVGVYFYSLATTSAKAKEEAEFCIKHLKGKKISYPVYIDMEDPYKQAKQSKSTLAAVCNSFCNTIKAAGYKPGVYASLNWFNNKIGTITAAHSTWVAQYYTQCQYKGAYDMWQYSSSGSVPGISGRVDMNYWYNK

SEQ ID NO: 2837 - protein, 310 aa, unidentified
  REGION 1..310: note = Paludibacteraceae bacterium
MEKKGIDISQWQENINFQSVKNAGYEFVILRGSYTGSGATRGKYKDRCFEMFYEKAKKTGLKIGAYHYSCARTYDEGVAEARFIYENCLKGKTFDYPVYIDVEEAKWQQNYKKGTTDAILGFCNYIESKGFRSGVYSSAFWFSMILDTKRLNNISKWVASWRNTKPPFDFSHFDMWQKTGDERDRNVKIGGITVDTDVCFVEFGSSNSTKPSTNKKKKSIETIANEVIDGRWGNGSERKKKLTDAGYDYDSVQKKVNELLNVSETTYTVKKGDTLSGIAKKYKTTVAKLKKANDIKDVNKIYVGQKIVIK

SEQ ID NO: 2838 - protein, 74 aa, Solobacterium sp.
AAAGYDYAAVQAKVNELMSGAAPAAAPAALKPLEEVAKEVIRGNWGNGQERKDKLTAAGYDYAAVQAKVNELLK

SEQ ID NO: 2839 - protein, 161 aa, unidentified
  REGION 1..161: note = Oscillospiraceae bacterium
MGLFDKFKKKTEEAKTEVTETKTAAAAAANEALKKAEELKKKRAEAAAAEEAKLKAEAEKAAAEAKKVEDLAKEVIRGKWGNGQERKDKLAAAGYDYAKIQAKVNEILGGTAPVTGGKTVEELAKEVIRGKWGNGQERKDRLAAAGYDYAKIQAKVNELLK

SEQ ID NO: 2840 - protein, 526 aa, unidentified
  REGION 1..526: note = Oscillospiraceae bacterium
MKPIIDVSAFQGSIDWKAVSGNVEAAIIRLGYRGYGTGQIVYDDKYKVNRKGCEDNGIPFSLYFFPTSITDAEAVEEADFILQAVKGMKFVLPIFLDSEYAEGNGKGRSDQLSKADRTRFLKIICDRLQANGVPAGIYASTSWIKNRLDASQLPYSWWVAQWASKLSYSGDWLLWQYTSDGSVPGISGRVDCSQLKEGASISNPAAVPDTSVKGVTAEDVLDVMRSWIGLQKADQSHKVIVDTYNSYTPRARGYKANYQDAYCDITVSAAFIKLGAVDLIGGPECGVEEHVKLFKKAGIWEEDGTVTPQPGWLIVYNWDESQQPNDGYSDHIGVVEKVSGGKITTIEGNTSGGKVARCTYKVGHGNIRGFAKPKYAAASSKPAATKTVEELAKEVLAGVWGNGDDRKARLTAAGYDYNAVQARVNQLVATPAPAKKSVDELAKEVLAGSWGNGQERKDKLTAAGYDYSAVQKKVNELLSASSKSIDELAKEVIAGKWGNGDDRKRRLTAAGYDYARVQAKVNKLLS

SEQ ID NO: 2841 - protein, 134 aa, Solobacterium sp.
MPSFTSDNDNKLVNKGPSKAGMPTNIGKPAAAAAKPAAPAKKAVDVIVEEVIKGDWGNGEERKTKLTEAGYDYDMVQRAVNRKLGAEAPAKSIEDLAKEVIRGDWGNGADRKAKLEAAGFDYNAVQAKVNELLK

SEQ ID NO: 2842 - protein, 223 aa, Mogibacterium sp.
MAEEKKGLFGALKDKLNEAKEKAEEQSAAAAAKLEQKADNVKAEAKESAADAKIDFATAAASIASIKDVANAAVKEEKAEAAKAMADLKAKARAEALEKAAQAKAEAEEAAKVAEAEAKAAEEKLSDATIEKLAKEVIRGDWGNGDERKQKLTAAGYDYAKVQGKVNEMLGAAPKKAADKSVEQLAKEVIQGKWGNGDERKKKLTAAGYDYSAVQKKVNEMLG

SEQ ID NO: 2843 - protein, 159 aa, unidentified
  REGION 1..159: note = Erysipelotrichaceae bacterium
MGLFDNFKKKEEQKIEQAKKDLATLAREWNDGKWGKSEFEIRDNLKAAGYDNFTEIKKEAARLKEAAEQAKKIAQEAAKAAEERKAAAVASAKKSIEDLAKEVIEGKWGNGQERKEKLTAAGFDYTAVQNKVNDILHGVSDAEKKLEEIAKEVIQGKWG

SEQ ID NO: 2844 - protein, 247 aa, unidentified
  REGION 1..247: note = Clostridia bacterium
MIKIALSAGHGLNTLGNRCSKSLDRNETREWQLNARICGRVEELLKEYSGYELIRTDDISGKKDITLLSRVSKANKWGADIYISVHHNAGIKGGNGGGIMAFTYTKVDDVTKSWQRDLYNTLIKYTSLSGNRANPLSEASFYELRATSMPAVLLELGFMDSKTDVPIILSDSFADGCAKAIVEVIVKKGNLQKNTKEKPAFTGKSIDEIAREVIKGIWGNGSDRKKRLTQAGYDYSAIQARVNQLLK

SEQ ID NO: 2845 - protein, 174 aa, unidentified
  REGION 1..174: note = Clostridiales bacterium
MNDGELIRYSHWVARWGKSKPAPASGAETQIWQFGGETNLIRSNKINGQSCDQDYCYVDFPAKIKAAGLNGYAKGSSTPAPVKKSNEEIASEVIAGKWGNGAERQKLLSQAGYDYSAVQSIVNKKLSPSRKSVDEIAREVIHGDWGNGSDRKKRITSAGYDYSAVQKRVNELLK

SEQ ID NO: 2846 - protein, 301 aa, Ruminococcus sp.
MTAKGIDISGWNGEVDFQRVKADGIAFVIVKAGYSLSAVDTWERNYANAKAAGLHVGAYWYSYAKTAAEAKNEARSFIAALKGKQLDYPVYFDLEEKFQLDKGRAFCSEITDAFCGALRGAGYLAGLYISRSPLQDKITPEVAKKYELWVAEWGSKCRYDGDYGVWQYSETGRVNGISGNVDLDYCYKDYPTIIKSGGCNGYPQTGAKPVKTVGELAREVLDGKWGNGEERKRRLAAAGYDYGAVQGKVNELLRKPSKTVDELAREVIRGDWGNGDERKKRLTAAGYDYSTVQKKVTELMK

SEQ ID NO: 2847 - protein, 312 aa, unidentified
  REGION 1..312: note = Lachnospiraceae bacterium
MTLQIRKAVRAMTAKGIDISGWNGEVDFQRVKADGIAFVIVKAGYSLSAVDTWERNYANAKAAGLHVGAYWYSYAKTAAEAKNEARSFIAALKGKQLDYPVYFDLEEKFQLDKGRAFCSEITDAFCGALRGAGYLAGLYISRSPLQDKITPEVAKKYELWVAEWGSKCRYDGDYGVWQYSETGRVNGISGNVDLDYCYKDYPTIIKSGGCNGYPQTGAKPVKTVGELAREVLDGKWGNGEERKRRLAAAGYDYGAVQGKVNELLRKPSKTVDELAREVIRGDWGNGDERKKRLTAAGYDYSTVQKKVTELMK

SEQ ID NO: 2848 - protein, 50 aa, unidentified
  REGION 1..50: note = Lachnospiraceae bacterium
MRTASKKNVAEIAKEVISGKWGNGSERKQRLEAAGYNYAEVQAKVNEMLR

SEQ ID NO: 2849 - protein, 317 aa, unidentified
  REGION 1..317: note = Clostridium sp. AM27-31LB
MSQKFGIDVSHWQGSFDFARAKSKEGVEFAIIKAGGADAGLYKDSQFEANYKKCEKCGLPKGAYFYGNARSVADAKKEAEYFLSLIKGKRYEYPVFYDVEGSMITKNDRNTLTQIVKAFCSAIEAAGYWVGIYSSESFFNSEMNDGELTRYSHWVARWGKNKPAPASGAETQIWQFGGETNLIRSNKINGQSCDQDYCYVDFPAKIKAAGLNGYAKGGSSTSAPVKKSNEEIASEVIAGKWGNGAERQKLLSQAGYDYSAIQGIVNKKLSPSRKSVDEIAREVIHGDWGNGSDRKKRITSAGYDYSAVQKRVNELLK

SEQ ID NO: 2850 - protein, 273 aa, Campylobacter sp.
MQVNKLITRVNFTPATNRKIKYIVVHYVGATGGAEANCMYFLNWDRGASAHYFVGHVGEVWQCVEDKDIAWHCGAKKYVHADCRNSNSIGVEMCVRKDAKGNWYFEPQTVASTIDLVKELMSKYDIPVENVIRHFDVTGKMCPQPYVKDENAWRVFKNALVGGVVVKENTTVVKPTVKSVEVIAKEVIKGSWGNGSERKERLTKAGYNYTEVQDKVNELLGAKKQAAPPKSVDAIAREVIKGLWGNGADRKTRLEANGYNYREVQNRVNALLK

SEQ ID NO: 2851 - protein, 527 aa, unidentified
  REGION 1..527: note = uncultured Phocaeicola sp.
MSEKKKGIDISVWQGNIDAGQIKNSGIDFVIIREGYRQAVDSKFFDNVKKCKEVGLAVMGVYHFSYALNVEQARQEAQLVVANLQKAGLSKDTIVFFDFEYDTVTKAAAVGVTLGKAECNAHTKAFCETVKSLGYRAGVYFNIDYYRNWYDHALLDQYIKWLADWTGDADYPCDFHQYTSKGSVPGISGNVDMNYYFVPEIKENVVEVENAKPAVVTGVTAEKVLDIARGWIGFSEANGKFKEILDLYNSHKPLARGYAIKHTDSWCDCFVSACAIKAGAVDLIGTEVGCEKHVEIFKAMGIWNEDGSVKPAVGDVIVFNWDDSTQPNDGYSDHIGYVEQVYGDTVVCIEGNMNDQVGRRTINVGWGYIRGFAHPKYAKDNSAPIVATAKSIDELANEVLQGAWGNGDARKNAITAAGYDYAAVQKRVNELCGNSSKKSIDEIAKEVVNGAWGNGDARKNALEQAGYDYGEVQKRVNILVKTTKSSIDAIAREVIAGKWGNGQDRKNRLNQAGYDFAAVQKRVDELM

SEQ ID NO: 2852 - protein, 427 aa, unidentified
  REGION 1..427: note = uncultured Blautia sp.
MRIAREKFIADIAGYVKKYAGLYGILVYSPVIAQAVLESGWGESRLSSQYHNYFGLKCGTRWTGRSVNMRTQEEYREGTLTSVRDNFRVFDSMEEGVKGYFDFIQLERYRNLQGIWDPEEYLETIRADGYATSFSYVEDCMKVIRQYELTRFDEGGRETMAKTAESVLDVMRGWLGFSEANGKFKEIIDLYNSVKPLPRGYAVQYSDEWCDTCVSAAGIRAGCSELIGRECGVEEHVKIFKKLGIWIEDGTITPEPGYVIVYNWDKAAQPNDGYSDHIGFVEKVSGGKVTAIEGNRGEKVDRRVIPLGWGYIRGYAAPRYEKAVNGTGGNPGTGKKSVETVAKEVLAGKWGNGEDRKKRLQAAGYDYGAVQTKVNGLMKGSGKKSVEAVAKEVIAGKWGNGEDRKKRLQSAGYDYGAVQRKVNELMR

SEQ ID NO: 2853 - protein, 322 aa, unidentified
  REGION 1..322: note = uncultured Blautia sp.
LSFAQFEAEWRSVPLERMRSSCGICTTSFSYVENCMKVIRQYELTRFDEGRRETMAKTAESVLDVMRGWLGFSEANGKFKEIIDLYNSVKPLPRGYAVQYSDEWCDTCVSAAGIRAGCSELIGRECGVEEHVKIFKKLGIWIEDGTITPEPGYVIVYNWDKAAQPNDGYSDHIGFVEKVSGGKVTAIEGNRGEKVDRRVIPLGWGYIRGYAAPRYEKAVNGTGGNPSTRKKSVETVAKEVLARKWGNGEYRKKKLQAVGYDYPTVQTKVNELVKGSGKKSVEAVAKEVIAGKWGNGEDRKKRLQAAGYDYGAVQRKVNELMR

SEQ ID NO: 2854 - protein, 304 aa, unidentified
  REGION 1..304: note = Caudoviricetes sp.
MAILRPDTSTTLNGVKINEYLLTKHNPNRIDMPSVSMEGKVIGVTVHNTDWISVASGTTPAEQYTRATVNGNMKDVRVHYYVDNTCAWQNLPHSLSGWHAADGSGNGNRRTIAIECIMSSAYNVTGKKSEDNCARLAAALLKKYNLDINHLFTHTHWLNVRDGKSGTVDYLNTARNPYKMCPLYILPHWSAFKSKVQSYMKSGTSVSKNPTTKLLYRVRKSWSDAKSQIGAFSSLDNAKKACKPGYYVFDANGNVVYPTKKSVDEIAGEVIQGKWGNGTDRKNKLTNAGYDYNAVQKRVNELMK

SEQ ID NO: 2855 - protein, 330 aa, unidentified
  REGION 1..330: note = Lachnospiraceae bacterium
MKLVESILTKNPCYTAGRTIKVKGLMLHSVGCSQPSATTFIKNWNSPSFDRACVHGFIDGNDGTVYQTLPWNHRGWHCGSSINGSANNTHIGVEMCEPACITYTSGTTLKCSDIKTAKAVVKRTYEAAVELFAMLCKKYGLNPLADGVIISHKEGHSRGIASNHGDPEHLWSQLGTGYTMDTFRKAVKNKISGASDEKKTESVITASHMPATPFSVKIIIDDLNLRSEPSMNGTIKGQTGKGLFTIVEVKDGWGRLKSGAGWIWLENPSYCIIQGTVTKTAKTSSTKSVDEIAKEVIRGEWGNGEERKKKLVAAGYNYSVIQKKINEIMK

SEQ ID NO: 2856 - protein, 62 aa, unidentified
  REGION 1..62: note = Fusicatenibacter saccharivorans
MTKVKRGMGNELVKSSNKKSVETVAKEVIAGKWGNGGDRKKRLQAAGYDYGAVQRKVNELMR

SEQ ID NO: 2857 - protein, 62 aa, unidentified
  REGION 1..62: note = Blautia sp. TM10-2
MTEVKRGMGNELVKSSNKKSVETVAKEVITGKWGNGGDRKKRLQAAGYDYGAVQRKVNELMR

SEQ ID NO: 2858 - protein, 55 aa, unidentified
  REGION 1..55: note = Blautia sp. OF11-22
MGNELVKSSNKKSVETVAKEVITGKWGNGGDRKKRLQAAGYDYGAVQRKVNELMR

SEQ ID NO: 2859 - protein, 62 aa, unidentified
  REGION 1..62: note = Fusicatenibacter saccharivorans
MTEVKRGMGNELVKSSNKKSVETVAKEVIAGKWGNGGDRKKRLQAAGYDYGAVQRKVNELMR

SEQ ID NO: 2860 - protein, 278 aa, unidentified
  REGION 1..278: note = Absiella sp. AM27-20
MAKLFVICGHGAGDPGACGNGYQEAERVRVLGKRIKELGGNSVMLGDTSRNYYADNGISKLNISKDYQIIELHMDSAAASARGAHVIIYGGFSADAYDKALAKFISGLFPGRANTIVGRNDLANPARAASKGYGYRLMECGFISNATDVSIFNANIDKIAKGILDCFGITVSENSKPSPTPTPAKKSVDEIAKEVIAGKWGNGDDRKKRLTAAGYNYSTIQARVNELCGVPSNKKSVDTIAREVIHGDWGNGADRKKRLEKAGYNYNEIQKRVNELCG

SEQ ID NO: 2861 - protein, 93 aa, unidentified
  REGION 1..93: note = Lachnospiraceae
MIPLGWGYIRGYAAPQYEKAVKGTGGNPGTGKKSVEAVAKEVIAGKWGNGEDRKKRLQAAGYDYPAVQAKVNELVKSKVYGSRNERTSCKAVG

SEQ ID NO: 2862 - protein, 93 aa, unidentified
  REGION 1..93: note = Fusicatenibacter saccharivorans
MIHLGWGYIRGYAAPQYEKAVKGTGGNPGTGKKSVEAVAKEVIAGKWGNGEDRKKRLQAAGYDYPAVQAKVNELVKSKVYGSRNERTSCKAVG

SEQ ID NO: 2863 - protein, 304 aa, Ruminococcus callidus
MAILRPDSTSTLGGVTVKEYLLTKHNPNRIDMPSVSMTGKIIGVTVHNTDWISVASGTTPAEQYTRATVNGNMNDVRVHYYVDNTCAWQNLPLTLSGWHAADGSGNGNRRTIAIECIMSSAYNDRDKKSEDNSAKLAAALLKKYNLGVDHLYTHTHWLNVRDGKSGSVDYLNTARNPYKMCPLYILPHWSAFKAKVQSYMKSGTSVSTNPTTKQLYRVRKSWSDAKSQIGAFASLDNAKKACKSGYSVFDGNGNVVYPTKKSVDEIAGEVIQGKWGNGTDRKNKLTNAGYDYNAVQKRVNELMK

SEQ ID NO: 2864 - protein, 304 aa, Ruminococcus callidus
MAILRPDSTSTLGGVTVKEYLLTKHNPNRIDMPSVSMTGKIIGVTVHNTDWISVASGTTPAEQYTRATVNGNMNDVRVHYYVDNTCAWQNLPLTLSGWHAADGSGNGNRRTIAIECIMSSAYNDRDKKSEDNCARLAAALLKKYNLDINHLYTHTHWLNVRDGKSGSVDYLNTARNPYKMCPLYILPHWSAFKAKVQSYMKSGTSVSTNPTTKQLYRVRKSWSDAKSQIGAFASLDNAKKACKSGYSVFDGNGNVVYPTKKSVDEIAGEVIQGKWGNGTDRKNKLTNAGYDYNAVQKRVNELMK

SEQ ID NO: 2865 - protein, 50 aa, unidentified
  REGION 1..50: note = Lachnospiraceae
MKSSNKKSVETVAKEVIAGKWGNGGDRKKRLQAAGYDYGAVQRKVNELMR

SEQ ID NO: 2866 - protein, 50 aa, unidentified
  REGION 1..50: note = Lachnospiraceae
MKSSNKKSVETVAKEVITGKWGNGGDRKKRLQAAGYDYGAVQRKVNELMR

SEQ ID NO: 2867 - protein, 305 aa, unidentified
  REGION 1..305: note = Caudoviricetes sp.
MSNSPLVNYTKISPNKSSPRNHKIDTVTIHCVVGQCSVETLGNVFAPTSRQASSNYGIGYDGCIGMYVEEKDRSWCSSNAANDNRAITIEVASDTKEPYAVTDKAYAALIDLLVDICKRNGIKELKWKADKSLIGQPDKQNMTVHRWFANKSCPGTYLYERHAQIASAVNKRLGSTNIKPAPEKPSGGLYRVQTGAFKSKTNADAMLAKVKAKGFDTYMVKVGDLYKIQVGAFKVKANAETMMKKLQAAGFSAFITTEEGTGKSVDELAREVLQGKWGNGAERKKRLEAAGYDYAAVQKKVNQLA

SEQ ID NO: 2868 - protein, 110 aa, Solobacterium sp.
MSGKAAPAAGLKALDVVAKEVIRGDWGNGEDRKQKLAAAGYDYAAVQAKVNELMSGAAPAAAPAALKPLEEVAKEVIRGNWGNGQERKDKLTAAGYDYAAVQAKVNELLK

SEQ ID NO: 2869 - protein, 210 aa, Solobacterium sp.
MALKDLFKKKDTNDATQSASGVTAADIAALGKKKDDKKEEVKPAPAPVKPAATAVKPAATVVKPAVKPAAAPIKPAVTVKPAAPALKAVDDIAKEVIHGDWGNGEERKEKLTAAGYDYATVQAKVNEIMSGKAAPAAGLKALDVVAKEVIRGDWGNGEDRKQKLAAAGYDYAAVQAKVNELMSGAAPAAAPAALKPLEEVAKEVIRGNWG

SEQ ID NO: 2870 - protein, 304 aa, unidentified
  REGION 1..304: note = Clostridia bacterium
MIKGIDVSSWQGVIDYKKVKAGGIDFVIIRAGFGREVSQKDNCFEQNYSAAKAAGLDVGAYWYSYADSAEDAVREAKACMEVIKGKKFEYPIYFDLEEQSQFAKGKSFCDSVIKAFCGELEKNGYLAGLYCSTYYLNNFVSNNVAGKYPLWVAQYNYRCTYTANKYGIWQYSSEGRVNGISDNVDMDYCYTDYPSIIKNGGYNGYKKSVTAEKKTVTQLAKEVIEGKWSNGDERKQKLTEAGYNYSAVQKKVNELCEKMKIDEVANEVIQGKWGNGEERQQKLTNAGYDYDKVQARVNELMKEQ

SEQ ID NO: 2871 - protein, 494 aa, unidentified
  REGION 1..494: note = Duncaniella sp.
MTAKDIIVAMQTDSNWWQYKNSTIKPVGIVVHSTGTKNKTAKRYVNAPEQLGKNPNGNWFGSPKGAGGDPYALPHGVVGADKNGKAVACQILPWTAHCQGCGSGKYGSYNKLSDGTGYIQFEIAEGENTDTAYFNDAMNVAAELCAYLMSLYPDIKIENIVSHKEANARGYASGHGDPENYLKPFGKDMNWFRDKVKGYVKTGNAASSTVTKTVKFSPRLTAPSATDKHWIKSTRGGLNDCIEISGGSVLPNCVGYAWGRFYEIIGEKPRLSKNNAEMWYGNTADGYKRSQTPALGAVICWSKGVVGNEADGAGHVAIVEQILPNGDIVCSNSAYGGSRFYTQTYKKSDGYSFGAYKFQGFILPPVQIKNVTSAAASAPATAFKVGDIVEFTGSTNYKSSTGTRGIACKPGKAKITRIANGTAHPIHLIKDGSGSTVYGWVNTEDVQYITKKTVDEIAREVIRGDWGNGDVRKKRLIEAGYNYSEVQARVDKLI

SEQ ID NO: 2872 - protein, 109 aa, unidentified
  REGION 1..109: note = unclassified Blautia
MITAIEGNRGEKVDRRVIPLGWGYIRGYAAPQYEKAVKGTGGNPGTGKKSVEAVAKEVIAGKWGNGEDRKKRLQAAGYDYPAVQAKVNELVKSKVYGSRNERTSCKAVG

SEQ ID NO: 2873 - protein, 140 aa, unidentified
  REGION 1..140: note = Blautia sp. OF09-25XD
MITAIEGNRGEKVDRRVIPLGWGYIRGYAAPQYEKAVKGTGGNPGTGKKSVEAVAKEVIAGKWGNGEDRKKRLQAAGYDYPAVQAKVNELVKSSNKKECGNCSKGSHCRKVGNGGDRKKRLQAAGYDYGAVQRKVNELMR

SEQ ID NO: 2874 - protein, 312 aa, unidentified
  REGION 1..312: note = uncultured Solibaculum sp.
MIISNGIVQDKTIGGVPVVSSIVSPKGSRNVRTLKLLSTSDGNPTYIVVHNTGNSASSADARAHYSWLQGVENSDSSYVSVHFFVDEDEAVQTCPVTEMTYHAGDGSTGKGNSQGLSIEICENNNYQKAEKNAIRVIRALMDHFGIPIDRVQPHRYFAPNKKLCPHLILKSENAWQSNWSAFQQHILDSSDDSAPSQPSKSVDEIAREVIAGKWGNGSQRKERLTAAGYDYAAVQAKVNELMGGGSSGSPSAAIAVGDTVRITCNAYSTGQAIPSWVKNTSHKVSQIKGDKALLGYPDGIASWVPLSGIVRA

SEQ ID NO: 2875 - protein, 371 aa, unidentified
  REGION 1..371: note = Bifidobacterium simiiventris
MQGIDVSSYQPADITCTAQYDFAVVKVSQGVGYENPSWRQQAQCVIDKGRKLGLYHYAGGNDPVSEADYFTALAKPYIGRATLNLDWEQYQNTAWGDATWVRRFVNRVHESTGVWPLVYVQASALGQIPADVRKNCGLWVAQYASNAQTTYQANPWNYAIYGEAMRQYASNGRINGYSGPLDLNYFRGDGGQWDAYANPARKPQTVTKPVTPSSSHTATAPKPSLDTLVAATLRGDYGNLPERKQRLGSDYERVQAEINRRADTTTGSTTAVTRSTSVTVRAGDTMNAIMQRTGLYPLSAWRVPSGDPNRIWPGQTVTYNGGGTVATTTPSGHVVRAGESLWSIYGTGWSAAAARNGIPAPYIIHPGQILR

SEQ ID NO: 2876 - protein, 408 aa, unidentified
  REGION 1..408: note = Bifidobacterium simiiventris
MDHRNHIRNKGKPRARGLAASVVAILLAFTPAIALADMQGIDVSSYQPADITCTAQYDFAVVKVSQGVGYENPSWRQQAQCVIDKGRKLGLYHYAGGNDPVSEADYFTALAKPYIGRATLNLDWEQYQNTAWGDATWVRRFVNRVHESTGVWPLVYVQASALGQIPADVRKNCGLWVAQYASNAQTTYQANPWNYAIYGEAMRQYASNGRINGYSGPLDLNYFRGDGGQWDAYANPARKPQTVTKPVTPSSSHTATAPKPSLDTLVAATLRGDYGNLPERKQRLGSDYERVQAEINRRADTTTGSTTAVTRSTSVTVRAGDTMNAIMQRTGLYPLSAWRVPSGDPNRIWPGQTVTYNGGGTVATTTPSGHVVRAGESLWSIYGTGWSAAAARNGIPAPYIIHPGQILR

SEQ ID NO: 2877 - protein, 347 aa, Anaerorhabdus sp.
MTLLGIDIASHQSVEVAGMDGIDFVIVKATQGTWYTNPDGDKQYQTAKAKGRLLGSYHYAEGGDPVAEANFFVDSIQGYIKEATLWLDWEQGENKAWGNTNWCRAFVNHVYARTGVWCGIYVQASALNQVANLASDCPLWIAGYPTNDPGWTVPTFMYSTAPWPVYTIWQFTSGGKLDKNIANLTAADWKRIADPKGNPGTVTTTTKAPAAAPRSLDSLANEVNLGTYGDGDERKQKLGSMYNGVQAVVNHRAGYTSQAIEDLANETIAGVYGDGERRKQILGGFYGPVQERINAKFNAPQVRTYTVKSGDTLSGIAAKLGIGTNELINKNGISNPDLIFAGQVLQY

SEQ ID NO: 2878 - protein, 463 aa, Streptococcus suis
MALNMEQAIAWMEARRGKVTYSMDYRNGPNSYDCSSSVYFALMSVGAVSAGWAVNTEYMHDWLIKNGFKLIAENSVFAAQRGDIFIWGRRGQSSGAGGHTGIFVDSNNIIHCNYARNGITVDNYLATARASGNMYYYIYRPSGQSTVSTSTAGKSIDQLVQETLAGKYGNGDQRKAALGPQYQAVMDRINGKASAVEKSDEELAREVLAGKHGNGEDRKRSLGPRYPAVQKKVDELLKKPASPQPAPKVETPKQEPAQVQVQEDGDLSFNGAVLKSEVLKKILAKCKEHDILPSYALTILHYEGLWGTSAVGKADNNWGGMTWTGQGNRQSGVTVTQGTARPSNEGGHYMHYASVDDFLTDWFYLLRAGGSYKVSGAKTFSDAVKGMFKTGGAVYDYAASGFDSYIIGASSRLKAIEQENGSLAKYDTATVTDVGSTDKIEVNIEGIEISINGVIYELTKKPV

SEQ ID NO: 2879 - protein, 466 aa, Streptococcus suis
MAANMEQAIVWMEARRGKVTYSMDYRNGPNSYDCSSSVYFALMSAGAISAGWAVNTEYMHDWLIKNGYKLIAENQDWDAKRGDIFIWGRRGQSSGAGGHTGIFVDPDNIIHCNYANNSITINNYNQTAAASGWMYCYVYRLGNQPTTSPAGKTLDTLVKETLAGKYGNGDQRKAALGPQYQAVMDRINGKTSPVEKSDEELAREVLAGKHGNGEDRKRSLGPRYPAVQKKVDELLKKPASPQPAPKVEAPKVETPKQEPAQVQVQEDGDLSFNGAVLKSEVLKKILAKCKEHDILPSYALTILHYEGLWGTSAVGKADNNWGGMTWTGQGNRPSGVTVTQGSARPSNEGGHYMHYASVDDFLTDWFYLLRAGGSYKVSGAKTFSDAVKGMFKTGGAVYDYAASGFDSYIVGVSSRLKAIEAENGSLDKFDKLTVTDVGQSDKIEVTIEGIEISINGVIYELTKKPV

SEQ ID NO: 2880 - protein, 145 aa, unidentified
  REGION 1..145: note = Bacteroidaceae bacterium
MKQKEIFREEDFEKEPPHKPSTIWRKSWLWLSLFFIIIICIYCIINCDKKTMPSPSPSPNVDSLDIIDGKTNNSIIASNDTLKRIESPTIPQESVKTKLDISLMAKRVIRGDYGNGIQRQEALGGDYEIIQEQVNRNYQKGDLYW

SEQ ID NO: 2881 - protein, 124 aa, Bifidobacterium pseudocatenulatum
MATAMIRGDYGDGETRKGRLGTNYELVMRIVTQRFNESAAYAPVASGRSVSVTVRNGDTMSGITKRTVSVWSAPSGNINLIYPGSIVTYRGTPTAVSGSAATGGRVHIVKRGETLSGIFGADGW

SEQ ID NO: 2882 - protein, 69 aa, Bifidobacterium catenulatum
MATAMIRGDYGDGETRKGRLGTNYELVMRIVTQRFNESAAYAPVASDQSVSVTVRNGDTMSGITKRTGL

SEQ ID NO: 2883 - protein, 390 aa, Collinsella sp.
MAGILPTIIDISEFQGGVAWATCKSNIHFAIIRVQDGTYQDARAGRNISECERLGIPYYVYGFYRNGGAVEAARLVSRTKALGGANCRGHVLDVEVGGQSVAGINSAVATLNQTGRDTGVYIANHLYSQYAGVKGQKWTWIPTYGVNDGSAHTPPRHYCDLWQFTSAGRVPGIGGNVDCNALNGKRDLASFTAGTKPVEPQKPEQADPSLPLHVLVGNVLSGMYGNGENRKTSLGSRYAEVQEAVNHVCAAKVSVLADEVLAGKWSNGDERKRALGTRYDEVQEEINRRAGASAKKTVDQIADEVLAGKWGNGQGRRNRLASAGYDPDAVQAKVNAKLGVTSSNARCYTVKSGDTLSEIGAELGVNWKDIAAKNGISSPYTIYPGQVLEV

SEQ ID NO: 2884 - protein, 347 aa, Ruminococcus torques
MSMNGIDISNWQNGIDLTKVPCDFVIIKATQGTDYVNPDYDRAYQQAKNAEKCLGVYHYASGGDAEKEAQFFIENVSGHIGEAILVLDWEKEQNKNFGVCDFDWVKKWLNYVFKKTGVKPLIYTSKSFMNRFDGIGDFGMWIAQYASNDVTGYQETPWNEGAYNCAIRQYSSHGRLSGYAGNLDLDKFYGDKEAWSRYAAGAGKTENKENTSNVSGSTLEIAEGVMKGTYGDGDDRRKKLGSLYDRVQNFINHIATAPIETLVEETLAGTYGNGDTRKVVLGTRYDEVQNRINATHGNNSAIYYTVQDRDTLSEIAEKYGTTYQKIASMNGIQDPNKIYAGQKIRVK

SEQ ID NO: 2885 - protein, 360 aa, unidentified
  REGION 1..360: note = Caudoviricetes sp.
MAEFKGIDVSKYQGEINWDKVKASGVQFAIIRCGLGNDLKSQDDKQFERNYAECRRVGIPVSVYFFSYALTTSKVTSEMSHIKRLLNGKTIDGPVYIDVENTKGLDWRTISNEKMLEVMKEFYNQLTAAGYKMGIYSSRSAFWNEKMTDAWYDNVSKWVAEYASKVNDFTRTYDIWQYSSKGVVDGISGNVDMNIMYNEVIKSSDTTTDTAPVKKSNEEIATEIINGQWGNGDERKQRLTEAGYDYSAVQKIVNERLNKTVPVKSNEEIANEVLKGQWGNGAERKNKLIAAGYDYDTIQNIVNNKVGTPKPSYVTYTVKRGDTLSSIAVRYHTNYRKIASDNGISNPNRIYVGQVLKIYK

SEQ ID NO: 2886 - protein, 509 aa, unidentified
  REGION 1..509: note = Caudoviricetes sp.
MKLVESILTKNPCYKARRKITVKGLMLHSVGCPQPKASAFINSWNSESFDRACVHGFIDGNDGTVYQTLPWDHRGWHCGSSINGSGNNTHIGIEMCEPSCITYTGGASFKCSDLDTAKAVTERTYKAAVELFAMLCQKFGLNPLADGVIISHKEGYARGIASNHGDPEHLWSQLGMGYTMDTFRKAVKEKMSDSSDVTSGTQADVFAGFSEKDAIPIIGNLCREDMKKSGILASISAAQFILESGYGKSELAQKANNMFGMKKSLSGNTWGGSSWDGTSIYTKETKEQNADGSYETITADFRKYPCVEDSVADHSAYLLGAKNGKSLRYKGIKGMTDYKAVAQLIKDGGYATSLTYMEKLCSIIEKWNLTQYDVSDANVSAPSKSDTVTDFPSTPFTVKVIVDDLNYRSQPSMKGKVNGQTGKGVFTIVEVKDGWGRLKSGAGWIWLENPAYCTIQKTVKKATSTKSADEVAKEVIRGDWGNGAERKEKLTAAGYDYAIIQKKVNELLG

SEQ ID NO: 2887 - protein, 305 aa, unidentified
  REGION 1..305: note = Clostridia bacterium
MKVIDVSEFQGFINWDKVSADVNSVIIRAGYRGYGQGSLVSDVRFNQNIDGAAKAGLNIGVYFVTQAISEAEAKAEARYTINLIKSHKVKLTLPIFIDSENGHPKGLGRADANKLSAEKRTAILSAFCDEIHKEGYAAGIYASEYWLKALCNLTKLNKYFLWVAKYSSTAPIINYDAWQYTSKGRVIGISTNVDLSDFKTNLKPQGKKKTKKKSTETIAKEVINGKWGNGSERKQRLIAAGYDYKAIQSKVNELLNIKAETYTVKAGDTLGAIAKKHNTTVNKLVSLNNISNPNKIYVGQIIRIK

SEQ ID NO: 2888 - protein, 325 aa, Clostridium sp.
MATFLKADKTTTLNGVKVNEYLLTKHNPNRIAMPTASMKGSVIGVTVHNTDWINVASATTPAEQYTRATVNGNMNDVRVHYYVDDKCAWQNLPLDLAGWHAADGQGNGNRKTIAIECIMSNRGIASDKNSEDNCARLTAYLLHKYGLGIDRLYTHTHWLNVKAGKKGSVDKLNTMKNSYKNCPAYILPHWSTFKAKVKTYLDALNGTKPVSTPTTPATQTKPTTTTKPSTTKKSDDEIAKEVIEGKWGNGEDRKKRLTFAGYNYNTIQRKVNALLSKPTPTKSITEIAKEVINGKWGNGSIRKQRLTKAGYDYDTVQREVNRLLK

SEQ ID NO: 2889 - protein, 302 aa, unidentified
  REGION 1..302: note = Mediterraneibacter catenae
MAHIFIIAGHGDGDPGASGNGYKEYERVRALAKKIKAYGGDNVTVGDTSRDWYKDNLISSLNISKDWQIVELHMDGASASSARGGHVIINSTYDPDKYDKALAEFISDILPGRASTIVKRSDLANPKRAAAKGYPYRLLECGFITNAQDVKIFNGQMDDIAKGILSIFGIKASGSESASKPDESKSAASTGKKSTDTIAKEVIAGKWGNGDDRKKKLEAAGYNYNTIQNRVNEMLGVKSSGTAKKTLKVGMKAKPKTAVSYDGVKLISSVTKKYYKVIEIKGSRVVLGDSLNTAFNISNLTY

SEQ ID NO: 2890 - protein, 468 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVCILGKRGYSSGAGGHVVIFVDNVNVIHCNYARNGITIDNYNQVHRGMYYYLYRPANQPSISNKSLDQLVKETLAGVHGNGDARKASLGNQYEPVMAVINGKATAPKKTVDELVQEVIAGKHGNGEARKQSLGADYPVVQKRVTELLKKQPSEPSKGVEVKQPTETKISQTEPTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYATVDDFLADWFYLLRSGGSYKVPGAKTFSEAVKGMFKVGGAVYDYAATGYENYLVGMSSRLTAIESENGSLAKYDQQTVTDVAKIDKIEVAIEGIEVTINGTRYRLTKDPI

SEQ ID NO: 2891 - protein, 468 aa, Streptococcus suis
MTINLETSIRWMSDRIGKVSYSMDYRNGPNSYDCSSAVYYALMSGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPANQPSISNKSLDQLVKETLAGVHGNGDARKASLGNQYEPVMAVINGKATAPKKTVDELVQEVIAGKHGNGEARKQSLGADYPVVQKRVTELLKKQPSEPLNGQEVEQVAETKISQTELTGQATAGKEEGDLSFNGAILKKSVLDVILAKCKEHNILPSYAITVLHFEGLWGTSAVGKADNNWGGMTMTSNDLQITRPSGVIVTRGLARPSNEGGYYMHYASVDDFLTDWFYLLRAGGSYKVSGAKTFSEAVKGMFKVGGAVYDYAASGFDSYIVGASSRLKAIEAENGSLAKYDQQTVTDVAKIDKIEVAIEGIEVTINGTRYRLTKEPI

SEQ ID NO: 2892 - protein, 77 aa, Bifidobacterium pseudocatenulatum
MEALATAMIRGDYGDGETRKERLGENYELVMHIVTQRFNESAACVPAVSARSVSMTVRNGDTMSGIARRTGLWPLSA

SEQ ID NO: 2893 - protein, 279 aa, unidentified
  REGION 1..279: note = Oscillospiraceae bacterium
MSKTNTGLVAYAKAQLGKPYWYGTFGNTSSYALYKSKKSQYPDNYRWDCKDNQPGTNPSKQLGVKVHDCVGLIKGYLWCDSAEGSPKYNSKQDVSANGMYSVCTRKGTITTMPEVPGVLVFMDHHVGVYIGDGYVIEAKGHKYGVVKTALKGRGWTKWGYCPYITYEEAPKKPTTQPTTKPSSSGKKTVAEIAKEVIEGKWGNGDERKKKLKAAGYDYNAVQKEVNKQLSSGTKKKSITEIAKEVIAGKWGNGATRKAKLEKAGYNYLEVQKEVNRLLK

SEQ ID NO: 2894 - protein, 405 aa, Streptococcus equi
MVVDTEKAIAWMGLKEGHVSYSMDYRNGPDSYDCSSAICSALIYAGASNPGWLLNTEYMHDWLIANGYVLIAENEDWESQRADIAIWGLRGQSAGAGGHVVMFIDADNIIHCNYARNNITIDNYNQTAAASGWMYSYVYRYAGTQSQPATSKSVDELVQEVLAGLHGSGEQRKISLGANYDVVQTKVNELLKQPKVAEQSPAVKQDGDLLFNGAVLKKSVLDTILTKCKEHDILPSYAITVLHFEGLWGTSAVGRSDNNWGGMTWTGQGNRPSGITVTQGTARPSAEGGHYMHYSSVDDFLTDWFYLLRANGSYKVSGAKTFSDAIKGMFKVGGAKYDYAASGYDNYLVGMAGRLKAIEQENGPLSKYDQQADISAGQSDKIDVVIDSIEITINGVTYTATKKPI

SEQ ID NO: 2895 - protein, 465 aa, Streptococcus suis
MTINLETSIRWMSDRVGKVSYSMDYRNGPNSYDCSSAVYYALMAGGAISAGWAVNTEYMHDWLIRNGYVLVAENKPFNAQRHDVFIWGKRGYSSGEGGHTGIFVDNVNIIHCNFKRNGITIDDYNKVSRGMYYYLYRPTNQPSISNKSLDQLVKETLAGVHGNGDARKASLGNQYEPVMAVINGKATAPKKTVDELVQEVIAGKHGNGEARKQSLGADYPVVQKRVTELLKKQPSEPSKGVEVKQPSDTKISQTEPPGQATVSKEEGDLSFNGAILKKSVLDVILAKCKEHNILPSYAITVLHFEGLWGTSAVGKADNNWGGMTWTGQGNRPSGVTVTQGSARPSNEGGHYMHYASVDDFLTDWFYLLRAGGSYKVSGAKTFSEAVKGMFKIGGAVYDYAATGYDNYLIGMSSRLKAIESENGSLAKYDQQTVTDVGQFDKIEVAIEGIEVTINGTRYKLTKEPI

SEQ ID NO: 2896 - protein, 486 aa, unidentified
  REGION 1..486: note = Hutsoniella sourekii
MLTYNGSTLDDTTLSMLVKEAERLSVPPSYLIVKLHFEGLWGSSEVAKLNNNLSGMSMPNDAPDIFTRPSGVVVKRGSNRPTNEGGQYMKYANLQDFFTDWLYLIRRGGSYKIADSATFAEAVKGMFRYGGAKYDYATMNLPDSQSKQRYEAYLKGMLSRRTAINHANNGALDKLDNKEGVGSMTTAQDVIRIARKYNGVRKYSNQYKGLMSRYNNYPKKRFANRPVPNHSAGYDWCAMFVSAVMIEAGIGNKVPLEISVGYMKEGAQRLGQWVGRNNPKTGDIIIFDDEKGNDWPDHVGLVTAVSGNTVYTIEGNIGGYDAQSRVAERSFGKSDYYIQGYIRPPYGQAKVADLSKVPTDTLAQRVMAGDFGTGEQRKASLGARYEEVQKRVNELLTQGKKPQEEAVQGIIDGKYGNGQERVNKLKSEGYTEVEIAEIQEAVNKKLAEDKQETLVPAVSQKEEEKQQLADNEFLDKDGVVWVWEKK

SEQ ID NO: 2897 - protein, 103 aa, Nosocomiicoccus ampullae
MSKKKTTIKPKSKTISQLAVEVLAGKHGNGDARKRSLGSNYAKVQTEINRRMGVNVRPTSKSVATIVNEVIAGKWGNGQDRFNRLKRADYDPNVIQREVNKRY

SEQ ID NO: 2898 - protein, 2280 aa, unidentified
  REGION 1..2280: note = Siphoviridae sp. ctmYS12
MSKQVDERVVSMQFDNKQFEANVKTSMTTIQKLKQSLNFKDSGKSLENLSKAANEVKFDKLLSGVETLEKRFSAMGIVGMRVIENLTDSAMQMVTKTKNLITSTIKQGGISRATNIENARFQLQGLLKDDEAVAAVMKNVSDSVDGTAYSLDAAAKVASQLAASGMRAGDEMFSSLRAVAGVAAMTNSSYEDIGRIFTQVAGQGRMMGDQLLQLSGRGMNAAATLAEQLGKTEQEVRDMVSKGQISFSTFASAMDNAFGEHAKKANETLNGAFSNVKSALARIGAEFVAPLIVQNGPLVQVLNTIREKVNDVKRNIVPFAELVTTTINKLATKVNAAISKLNIDKMFEKFSFLSRDFGASKIIKLVNGISKPIEKVTDTVKETVNAVTDLDDIVNKVIRGDFGNGAERLNKLTEAGQNYYKIQNKVNEALNNGFRFSEDQIQAQDKLLGVKENTVSETKSETTETVKLTDEKKKLIKELASMSDAQLRANGYTEEQIAAFRELRGVADKLGMPIDKLIDNIDELNGKWIIMDALKNIGNSIVSIFKAIGQAWKDIFPSSSTDTVFNIVAAFHKLSERMKVTDEDADKIKRTFKGLFAVLDLVSTLVGGGLRLALKATSYILSLFNLSLLDVTAILGDALVKFRDWVKGNNLITRAFETMAPYLKEFVSLIVEGIIAIKDWVVANEKITQGFKKILSYLREAGAGFKAWIEGAREAENIPVYIIQGLVNGLKNGISTVVSIAIELAKSIIQTVCGVLGIHSPSTEFYAIGLYIIQGLINGLKAGAKKVWDTVKSIGEAIVGVGKEIDYKYLGISTTALGLLIVLNKFTNAVTDIKEKVIDAGLGVVNSISSIFDSISKYVKARALKQQAKALLLLAVSIAALGATIYFISQIDTKSLIKGGIAIGVLAGMLIGLTVAMSKLDKLGVFSDKVGVMLLGMSVALLAMGKVATEIGKLEWEEIAKGIVFVGALELFIISLIAISKFAGTNAKDAGKMIFKIAGALLIMALVAKLAGNLRKDELTQGLKFIAVMGIFTTALVAVSLFAGKNASRAGTMILKIAGALLIMVMVAKIAGNMKPEELSQGLEFIEIMGIFTATLVAVSILAGKNASRAGNMILKIAIALQIMAKVVKTIGQLKPDEVEKGLKFIKTLGKFIVALVAVSLLAGKNASRAGIMMIGVAIAMGVMAQVVKMAGSIDENTLKQGLGVMAAFETFILALVAVSILAGKNAAKAGEMLLKVSVSLLILTGALFLIGQMDSKKLWKAVGVVAVLETLFAGLIAVTKVSQNANKTIIGLVATLTLLVSGLALLTTLNSDKLITSAESLSMVMVAMAAMIAATGQIKNTEGATKVLLQISLVVLMLVGVLGMIQTLNIEGNMGAVASISVLLVSMAASLALLGNTKNVSLKAVGAMALMGLVVAELAVVMKAMDKLNIDVSTKTVAQLSALLLAMSGALAILTVVGIGGAAAFVGIGALVTLIAAVGGLMIAIGALNDEFPAVADFVHNSIPILQDMGEGLGNFIGGLVGGVVAGAIDSLAGIGTSLSTFMENLQPFIEKVSAIDPDAMAGGEALAKMLLTLTAAELVSGLSKFLGVKDLGNLGSQLSDFGDAIIAFSDKLNNGDCINDKAVQKAAKAGEMMAKLQSSLYGTGGLKQDIFGEKDLGDFGSQMSKFADGIIAFATKVEVADINQDSVDAAAYAGETMATLQSKIKSQNGALQDIFGSQDLGDFGSQMSNFADGVVNFDKKLKANDGISSDLADQAAYAGNVMAELQNNTGAIGGVVKYFAGEKNLGTFGTQIALYGSALAAFSQVLSENPVDTTTVSIAKDCGLLMTELQTALPETHLFDGKMDLDDFGAKLMSFGKYMGVFANMTAQMDVSNLTTVSIAAKRLGEMTQSISAVDQTKIDEFDFEGIGNSIKTFCDSFDNVDASKVETAINSINKLVNTIKSMDGLNTNGVNTFKGILNSLSGDTVNLKGIGNSFSDDQIASFNSIGSSVVSAIASGMKSKSSEFTSIGHSILSSIKSSLNYNIQQFKTSGETIMSNFVSGIKGSRNTASSAFTSMMAFITLSLKGYYNNFYTIGGYLVTGFANGISASAYKAKAKAKDMAKDAEKAAREELQVHSPSKKLDKVGQYFGMGFANGIDKKSHLSVQAAKTMAASAIDSTKQTISRLGQILAMDVDAQPTIRPVMDLSDINSGVATMNGMLAMNPSVGVMTNIGAINASMRNRQNGNANDVISAINTLGKTLGNTRGDTYIIDGITYDDGSGINDAVQTLIRAARIERRM

SEQ ID NO: 2899 - protein, 266 aa, unidentified
  REGION 1..266: note = Caudoviricetes sp.
MAVKGIDVSRWQGNINWAKVKAAGIKFAILKAGGSDDGFYTDSKWEANYKGAKANGIAVGAYYFAGPRCVTAADGKADAKRFLKLLKGKTLEYPVYFDCEAQPVSKRSGTTKAALAFCKELEKAGYYAGIYASTYSGFENRLDDSKLKSIAHWVAQYASKCTYSRAFGIWQYSSIGKVPGIIGNVDMNLAYIDYPSIIKKNGLNGYPKPTAENKKSTSTAKKKSVDELAKEVLTGKWGNGTARKQKLKKAGYDYDAVQKKVNDLLK

SEQ ID NO: 2900 - protein, 322 aa, unidentified
  REGION 1..322: note = Caudoviricetes sp.
MNFVNAYLTHNRPGNKRRRTTAIAIHWVANPGTSAMANRNYFNNTDRSVSSNYIIGLTGEIVRCIPHGEESWCTNQANPYTVSIECCHPDWTGKFNTATYNAAVELCAELCKIYGLNPTNGGLIRHYDVTKKVCPKWFVPASAGGTDTNDEQHWKKFKNDVAAKMGKKTTASNSSTVKPSITVEQAAKNVIAGKYGNGEDRKKRIAALGLDYNTVQARVNQMLGIKTATSAHKPAAPASNSKVAAAKSKSDSIRGTYSVTATSLYCRYIPGKLTGDNVVTAFKNGTKVHCYGYYTTANNSKWYLVQSGKYTGYCNSKYLKKV

SEQ ID NO: 2901 - protein, 425 aa, Coprococcus sp.
MTKTEFISKVAGNVQKYASAYGILVHSPVIAQAILESGWGGSKLSSQYHNYFGLKCGSRWTGKSVNMKTQEEYTSGALTTISDNFRVYDSMEDGIRGYFEFIQLARYQNLKGITDPEKYLETIRADGYATSYSYVENCMKLIRQYGLTKYDKGENNIMGRTAESVLNVMRGWLGFNESNGKFKEIIDLYNSVKPLPRGYAVKYTDEWCDTCVSAAAVKAGCADLIGRECGVEKHIDIFKQKGIWIEDGAITPEPGYVITYNWDKSTQPNDGYADHIGYVESVSGGNITVIEGNKGEAVARRVIPVGWDYIRGYAAPKYDAATATPVPATGKKSVEEVAKEVLAGKWGNGDDRKNRLKAAGYDYAAVQEKVNQLVKSGSSNRKSVDTVAREVIQGKWGNGADRKKRIASAGYDYATVQKRVNELLR

SEQ ID NO: 2902 - protein, 261 aa, unidentified
  REGION 1..261: note = Lachnospiraceae bacterium
MPRHVRGWLGFSEANGKFKEIIDLYNSVKPLPRGYAVQYSDEWCDTCVSAAGIKAGCSELIGRECGVEAHVKIFKKLGIWIEDGTITPEPGYVIVYNWDKAAQPNDGYSDHIGFVEKVSGGMITAIEGNRGEKVARRVIPLGWGYIRGYAAPQYEKAVNGNGGNPGTGKKSVEAVAKEVLAGKWGNGEDRKKRLQAAGYDYPAVQAKVNELVKSSNKKSVETVAKEVIAGKWGNGEDRKKRLQDAGYDYGAVQRKVNELMR

SEQ ID NO: 2903 - protein, 187 aa, Ruminococcus callidus
MGSSYNDKDKKSEDNCARLAAALLKKYGLDINHLYTHTYWLNVRDGKSGSVDYLNTARNPYKMCPAYILPHWAAFKAKVQSYLNSGSIPTTPAPATKQLYRVRKSWSDAKSQIGAFSSLENAKKACKNGYAVFDSNGKQVYPAKKSIDEVAREVIQGKWGNGAERKKRLTDAGYDYNEVQKKVNQMI

SEQ ID NO: 2904 - protein, 255 aa, unidentified
  REGION 1..255: note = Lachnospiraceae bacterium
MQGIDISHYQKNINLAQVKGLDFVIIKATQGTGFIDPSLKDQISQAVKLGIPFGLYHYASQGGAEKEAQHFIDTIKGYIGKAILVLDWESGSNKNFNNPGYARAFLDYVKEKTGVTPFIYMSKSVCRQFKWGDTAAKYPLWVAQYKNKKPTGWQNEPWTDAKGYGAWISPLIFQYTSTGRVEGYGGNLDLDIAYISESVWDGYTKSSKEIDVDAIAQEVIDGKWGNGEDRKKRLTEAGYDYKVIQSRVNALLMQK

SEQ ID NO: 2905 - protein, 522 aa, unidentified
  REGION 1..522: note = Blautia obeum
MKGIDVSYWQDNIDWSKAKKDGVQFAVLREGYRNTIDKRFIENVKGCQKNGIAVMVYHFIYTDNASTVDNAKSTVANMKAAGLDIANTWIFADLEYDTWKRNGETCTREKCSLYTLEYIKALEKLGCKKIGVYMNIDYYKNYYTGDIKKNYKIWLADYNGEADFSCSMQQYTSSGKVSGINGNVDMNTLFDTGMLSKSDNKEENKTMGYDRTKVVAQAQSWLGCKESDGSHRKIIDLYNTQNPRPRSYKVQYTDAWCATFVSAVAVKLGYTRIIPTECSCNYMIKGFQQIGCWVENDAYVPKAGDVIFYDWQDTGSGDNTGSSDHVGIVEKCDGKTITVIEGNMSNKVGRRTLAVNGKYIRGFGVPKYDTESVPSGSGSSGKKSLDEIAREVLSGAWGNGDDRKNRLTAAGYDYNAVQSRVNQLASGSSSGTTKKSVSEVAKEVLAGAWGNGDDRKKTLIAAGYDYNAVQSEVNRLCNKKSIDTIVREVIAGKWGNGDTRKKKLQAAGYNYSEVQKRVNQLL

SEQ ID NO: 2906 - protein, 103 aa, Blautia wexlerae
MAREKFIADIVGYVKKYAGLYGILVYSPVIAQAVLESGWGESRLASQYHNYFGLKCGIRWTVETVAKEVIAGKCGNGEDRKKRLQAAGYDYGAVQRKVNELMR

SEQ ID NO: 2907 - protein, 94 aa, unidentified
  REGION 1..94: note = Butyrivibrio sp. MC2013
MATIEQIAKEVIQGKWGNGAERKAKLTAAGYDYDKVQALVNSLLKSDAPVKSIDDIAREVIKGNWGNGEERKKKLTEAGYDYSAIQAKVNQLLK

SEQ ID NO: 2908 - protein, 304 aa, unidentified
  REGION 1..304: note = Ruminococcus
MAILRPDTTTTLSGVKINEYLLTKHNPNHIDMPSVSMEGKVIGVTVHNTDWISVASGTTPAEQYTRATVNGNMKDVRVHYYVDNTCTWQNLPLSLSGWHAADGSGNGNRRTIAIECIMGSSYNDKDKKSEDNCARLAAALLKKYGLDINHLYTHTYWLNVRDGKSGSVDYLNTARNPYKMCPAYILPHWAAFKAKVQSYLNSGSIPTTPAPATKQLYRVRKSWSDAKSQIGAFSSLENAKKACKNGYAVFDSNGKQVYPAKKSIDEVAREVIQGKWGNGAERKKRLTDAGYDYNEVQKKVNQMI

SEQ ID NO: 2909 - protein, 561 aa, unidentified
  REGION 1..561: note = Blautia obeum
MAFFMDPGAMFLGCLGPSEQKFLVTLIETAAKSGYTRFVEPCAGTFAMANLAVQNGFKPEQIETSDVNMMSTVLGYAITGQSLEPLEIHAQGFSDEELLDPATALYAQLYLRTSKNAGNDYFYQILTDLRLRREEHIESINRQIEVIRNLLGGMSYRPLDMWEHLKEVLDDPHALVIANPPTYFSGYEKFYDTQGKMTWKEPPYELFDPETGHQQFYDLCMNAKALVICYQEKRVGEAVGYTIYARSGTRADLNAYITTNREEEATALANGKKIKRPAESKLQPLDCSMLPRDYEIKEDSKVQVIPVKAAEAQYYRELWTHNFVGSSATFNRALLIDGYVAGVFGISKMASDSVFVCLKPGDILLNDNHHVAIAVSGDASSNATPAKKNYLEKGDTGSEVTAMQKMLIKVGYSCGAAGADGDFGSDTDSALRKFQKDNGLTVDGQYGTNSKAKLTALYNKKVGTTTSNKKDVTTVAKEVIAGKWGSGDERKKKLTAAGYNYDTVQKKVNELLKTRTKKSVAEVAKEVVSGKWGNGADRKKKLEAAGYNYAEVQKEVNKLLK

SEQ ID NO: 2910 - protein, 369 aa, unidentified
  REGION 1..369: note = Anaerococcus sp. Marseille-Q5996
MVSFKYKILGVGLALIILSPSTAFAAEIIKYDDSDLDQVFVDNNMEYDKKAVEDRKNEYLANPNNAIAPNYEVEKVIITEELTEDDNGDIEKTVTTETHLEDTNPSPLYSKTPVYKKVVDISEHQNPKNINYDKFADDIDGAILRTSITDAKTLNIRHDYHVNKHYNELNKRNVPIGFYHYSRAINASEAVREANFVYDYIKNKNVLLPVYIDIEDDNRQAKASKGDISAAAEAFVTFMQDRGYVSGIYSYPWFANNYLTRDVKNKYEFWIADYNSKDFTSYNKSDFSSWQFTHQARVNGYNGNVDMSVHYKDYPYMKTGVSRKPMNVLVDEIIAGKWGVGAERQRRLVYAGYNYDIIQKAVNQRLANA

SEQ ID NO: 2911 - protein, 264 aa, Blautia sp.
MKANASKRKVFQDALDLLDEDPVKNTPVAVNGIVSIPVEEIHPFHDHPFRLYEGERLEDMVQSIRDYGVLNPVIVRKAARGYEMLAGHNRTNAAKIAGLTEVPAIVKTDLSDEDAYVCGVEEHVKIFKKMGIWIEDGTITPEPGYVIVYNWDKAAQPNDGYSDHIGFVEKVSGGNVTAIEGNRGEMVARRKIPLGWGYIRGYAAPKYAKAVNGSGGSAGKKSVDVVAKEVIAGKWGNGEDRKKKLQAAGYDYGAVQRKVNELMR

SEQ ID NO: 2912 - protein, 239 aa, unidentified
  REGION 1..239: note = uncultured Ruminococcus sp.
MKYTNSKLVDYKRLSPNHSGLRTHKIDRITPHCVVGQCTVETLGSIFMDRSYEASCNYGIGKDGRVALIVEEKNRSWCSSSNKNDQRAITIECASEIYSPYEMNSKVYNKLIKLCIDICKRYKKKKLLWFSSKSKSLSYKPKSDEMVLTVHRWFANKSCPGDWLYSRLGNVAKEVTKALNTSTTTKPNTQTSSKKKSVDTIAREVIQGKWGNGSARKSKLTKAGYDYNAVQKRVNQLLV

SEQ ID NO: 2913 - protein, 318 aa, unidentified
  REGION 1..318: note = Anaerobutyricum hallii
MSEIKRFGIDVSHWQGDFDFARAKSKEGVEYAILKAGGGDAGLYKDSKFEANYKKCEDCGLPKGAYFYGNAKSTAEAKKEAEYFISILSGKKYEYPVFYDVEGKMITDNDRVTLTEIVKTFCSIVEAAGYWVGIYSSESFFNSEMNDGELTRYSHWVARWGKSKPAPASGAETQMWQFGGETNLIRSNKINGQTCDQDYCYVDYPVKIKAAGLNGYSKSSNTTPAKKSNVEIASEVIAGKWGNGVERKEKLTKAGYNYSEIQSIVNAKIGTPAKKSVDEIAKEVIRGDWGNGTDRKQRLIAAGYDYSVIQHKVNELLS

SEQ ID NO: 2914 - protein, 403 aa, unidentified
  REGION 1..403: note = Caudoviricetes sp.
MAYLNGIDVSNWQNGINLAAVQADFVICKATQGTTYVSPDCSRQVEQTAASGKLVGTYHYISGVGAVAEADFYLKNISNWIGKYMLCLDWEANQNSQWGNEAYLEQMVKRIIERTGIPPMIYVQQSRMSAVKPIAQRNNCGLWIAQYANMDQTGYQATPWNEGAYSCAIRQYSSAGRLSGYNGNLDLNKFYGDKNTWMKYCNPESAHEDAGGSAAPSQPASPTGSTLDLVVGTMQGKYGNGDSRKTALGSRYDEVQDMINHISTASASTLASEVKSGKYGNGETRKIVLGSRYDEVQKIVNGNSKKSVSVIADEVIAGKWGNGNDRKKKLQAAGYDYNAVRAEVNKKLGSGSGTSSKQYYTIRTGDTLSEIAKENGTTVKQLQSWNGIKNANVIYAGQKIRVK

SEQ ID NO: 2915 - protein, 239 aa, unidentified
  REGION 1..239: note = Caudoviricetes sp.
MKYTNSKLVDYKRLSPNHSGLRTHKIDRITPHCVVGQCTVETLGSIFMDRSYEASCNYGIGKDGRVALIVEEKNRSWCSSSNENDQRAITIECASEIYSPYEMNSKVYNKLIKLCIDICKRYKKKKLLWFNSKSKSLCYKPKSDEMVLTVHRWFANKSCPGDWLYSRLGNVAKEVTKALNTSTTSKPNTQTSSKKKSVDTIAREVIKGKWGNGSARKSKLTKAGYDYNAVQKRVNQLLA

SEQ ID NO: 2916 - protein, 308 aa, unidentified
  REGION 1..308: note = Caudoviricetes sp.
MTMAILKPDNKTTFGGVTVNEYLLTKHNPNHIAMPSVSMEGKIIGVTVHNTAWITTVAGTTPAEQYTRATANGNMNDVRVHYYVDNTCAWQNLPHSLSGWHAADGSGNGNRRTIAIECIMSSAYNATDKKSEDNCARLAAALLKKYNLGIDHLYTHTHWLNVRDGKSGSVDYLNTARNSYKMCPLYILPHWAEFKKKVQGYMNAGSATAPTPSAPAAKQLYRVRKSWFDAKSQIGAFSSLENARRACKVGYAVFDSSGKQVYPVKKSIDEIAHEVIQGKWGNGAERKKRLTDAGYDYNEVQKKVNQMI

SEQ ID NO: 2917 - protein, 168 aa, unidentified
  REGION 1..168: note = Parascardovia denticolens DSM 10105 = JCM 12538
MNSVVTDSVKKRFTLWIAQWTPKCSYSGSYGIWQYSSKGKVSGISGNVDMDYSYIDFPSTIKNGGFNGYGKTASTSTTIAKKSVDEIAAEIIAGKWGNGSDRKSRITAAGYDYNAVQAKVNEKLGAATKKSTAVYYTVKSGDALSGIAKKYGTTVSAIQKLNSRSSGM

SEQ ID NO: 2918 - protein, 181 aa, Blautia sp.
MLAGHNRTNAAKIAGLTEVPAIVKTDLSDEDAYVCGVEEHVKIFKKMGIWIEDGTITPEPGYVIVYNWDKAAQPNDGYSDHIGFVEKVSGGNVTAIEGNRGEMVARRKIPLGWGYIRGYAAPKYAKAVNGSGGSAGKKSVDVVAKEVIAGKWGNGEDRKKKLQAAGYDYGAVQRKVNELMR

SEQ ID NO: 2919 - protein, 309 aa, unidentified
  REGION 1..309: note = Clostridia bacterium
MATKILKVIDVSEFNGGINWAKVAKNCDGAIIRAGYRGYGSGTLVTDDNFKSNIKWASAAGVPIGIYFYTQAISEAEAREEARYTMELVKGYKLNLPIFIDSEDAANGAGRADSGKLTKDKRTTILKAFCEEIQKEGYAAGIYASEWWLNNLLNINKIKNFYLWVAKYSTYEPNVDWDAWQYTSAGNIDGITGNVDISEFKDISVTKPTTNKPKKSVTEIADEVIAGKWGNGDERKAKLEAAGYDYNEIQNKVNEKLNKKTTKKYYTVKAGDTLTDIAKKYKTTVDKLVKLNNIANANKIYAGDKIRVK

SEQ ID NO: 2920 - protein, 318 aa, unidentified
  REGION 1..318: note = Muricomes intestini
MAYKGIDVSVWQGNSIDFNMVKASGIDFVIIRAGYGNGNKDKYFETNYSKAKAAGLHVGAYWYSYATSADGAKQEAKSCASVLSGKQIDYPVYFDIEEKSQLARGRNFCSSLTTAFCTELESRGYYAGFYTSLSSLNSVVTDAVKKRFTVWVAQWASKCSYPSAYGVWQYSSKGKVNGISGNVDMNYSYIDFPSTIKNGGFNGYGKSATANTSTTTVKKSVDEIASEIIAGKWGNGADRKKRLTAAGYDYNTVQAKVNEKLGTSSKKSTAIYYTVQRGDTLSGIAKKYGTTVSAIQKLNSSLIKNVNLIQVGWKIRVK

SEQ ID NO: 2921 - protein, 164 aa, Parascardovia denticolens
MTDSVKKRFTLWIAQWTPKCSYSGSYGIWQYSSKGKVSGISGNVDMDYSYIDFPSTIKNGGFNGYGKTASTSTTIAKKSVDEIAAEIIAGKWGNGSDRKSRITAAGYDYNAVQAKVNEKLGAATKKSTAVYYTVKSGDALSGIAKKYGTTVSAIQKLNSRSSGM

SEQ ID NO: 2922 - protein, 160 aa, Parascardovia denticolens
MKKRFTLWIAQWTPKCSYSGSYGIWQYSSKGKVSGISGNVDMDYSYIDFPSTIKNGGFNGYGKTASTSTTIAKKSVDEIAAEIIAGKWGNGSDRKSRITAAGYDYNAVQAKVNEKLGAATKKSTAVYYTVKSGDALSGIAKKYGTTVSAIQKLNSRSSGM

SEQ ID NO: 2923 - protein, 304 aa, Ruminococcus sp.
MAILRPDTSTTLNGVKINEYLLTKHNPNRIDMPSVSMEGKVIGVTVHNTDWISVASGTTPAEQYTRATVNGNMKDVRVHYYVDNTCTWQNLPLSLSGWHAADGSGNGNRRTIAIECIMGSSYNDKDKKSEDNCARLAAALLKKYGLDINHLYTHTYWLNVRDGKSGSVDYLNTARNPYKMCPAYILPHWAAFKAKVQYYLNSGSIPTTPAPATKQLYRVRKSWTDAKSQIGAFSSLENAKKSCKTGYAVFDSNGKQVYPAKKSVDEVAREVIQGRWGNGAERKKRLTAAGYNYNEVQKKVNQMI

SEQ ID NO: 2924 - protein, 177 aa, Bifidobacterium dentium
MAERQSQPVEVEEPQPAEPDYEALAQRVVAGEFGNGEARREALGADYERVQGIVDDMMAPQSAPVQSAPPVQPVQQSAPTPVEPSQVEPSEAAQPVEPADAPEDVVAEFSADPEGSWDSWRTEFGNDADVDVPLSQVPVCAALDGSTGTGYEKVCQATSEDGLHYVLVGGTAMEVWR

SEQ ID NO: 2925 - protein, 442 aa, unidentified
  REGION 1..442: note = Erysipelotrichia bacterium
MKNLKKMIVALIMTVSIVSLSGFSMVADASMKVTDVASWQGAYTVGSYGEDAVIVKATGGTAYKNPYFEYVANQAVAQNKPWGIYHYAGDQSSASAVAEARYFVNNIKQYLNVANKPVLILDWEAGGNANWGNGAWAREFIDEVKRLTGVQPGLYTGSDGVSQTGSYLANDTWLWFAGYPTMADVGWSPMSFPYSIGSWSTLTGWQFSSTPLDKSLFYLDIDTWNKLANNDGYIVNDNQAEPEASGAEVGRLEDLASKTQNGEYGNGDERKTNLGNDYTSVQTIINERSGVITGSESHETLKDEVLAGKLGDGDVRRVNLGTYYNSVQALINDSVGVSSSQTSTYTVVTGDTLSGIASQYDTSVSSLQSLNGIANPNLIYVGQTIVVDSVSNTKSSHGVVTVEYGDTLSSIAQIYNTTVSEIQNKNNIINPNLIFAGQNLII

SEQ ID NO: 2926 - protein, 392 aa, unidentified
  REGION 1..392: note = Caudoviricetes sp.
MAGILPTIVDVSSWQGDIDWDTARGYIHFAIIRVQDGTYYDGKLPRNIAAVERLGIPYYCYGFYRNGGSVEAARMVSRANAAGATNCRGYVLDVEVSGQSHSGIKSAMAVLNQTGLDNGIYIANHLFGEYGDDSYGEKWRWIPAYGANDGYAHRAPSHYCHLWQFTSSGAVPGIGNAIDCNALVGNRTLDSFTGSFTPAVQSGCGTVSDGEADYVLVGKVLSGELGNGDQRKQSLGSRYDEIQALVNHMCSASASEIASEVISGRWGNGDDRKKALGPRYDEVQEKVNQMFGGSSTKSVSQVASDVIAGKYGDGNTRKQQLQAEGYNYDEVQAEVNRQLGYSGGSSSYYTVQSGDTLSGIAAKYGTTYQQLAAINGISNPNVIYAGQRLRVN

SEQ ID NO: 2927 - protein, 293 aa, unidentified
  REGION 1..293: note = Bacteroidales bacterium
MVMRGIDISNWQAGLNIAKMDCDFFIMKATEGKTFVDAYCNEWVDDCIRLKKPFGFYHFAGTNNPIEEANFFYRQCKGYFGKGIPVLDYEVENSNNAQWCEKFIKRVHDLSGVWCMLYISAYRVGHYNDSWIPRKCPLWIAGYPKTYANWTIDKMPYSVKPWANAVIWQFTSQLILHGYVGKLDGDIAYMSAKRWNSYAKAKTTQTTDETEKKQTIDDIVKDVLDGKYGNGETRKKKLGKNYAKVQKRIDTLYDIADEVIDGKWGKGWNREQSLNGAGYPYELVQRIVNEKMA

SEQ ID NO: 2928 - protein, 74 aa, Bifidobacterium pseudocatenulatum
MATAMIRGDYGDGETRKERLGENYELVMHIVTQRFNESAACVPAVSARSVSMTVRNGDTMSGIARRTGLWPLST

SEQ ID NO: 2929 - protein, 74 aa, Bifidobacterium pseudocatenulatum
MATAMIRGDYGDGETRKERLGENYELVMHIVTQRFNESAACVPAVSARSVSMTVRNGDTMSGIARRTGLWPLSA

SEQ ID NO: 2930 - protein, 324 aa, unidentified
  REGION 1..324: note = Caudoviricetes sp.
MSNSSLVNVNVPAYSGNYTIGRSGRKIEMIAIHHMAGVLTAEQCGRIFQTVGRKGSSNYGIGKNADVGLYVDESNTSWCNSNWDSNCKSVTIETSNCSVGGNYPVSDAVLNKLIELVADIAKRNNLGTLVKGKNVVWHSMYANTNCPGAYLLSKLDYIIEQANKINNTQTNTTQSQTTKSIVDLANEVIAGKYGVGEARKQALGSLYNEVQAKVNEILGSKTTTVTNKKSIDTIAQEVIAGQWGNGQDRFNRLAAAGYEGNAVQNKVNELLGAKTAVSNKKSNEVIANEVIQGKWGNGSERKSKLTAAGYDYNAIQKIVNNKLK

SEQ ID NO: 2931 - protein, 335 aa, unidentified
  REGION 1..335: note = Caudoviricetes sp.
MGFSSLIRSKVLASSSNYTQGRKGYKVCKITPHHMAGVLSGEQCAKLFQNPNRQASANYCIGNDGGIVGCVDEDNRAWTSSSSSNDCQAITIEVSNSSTGGDWPISEAAWNSLVNLCVDICKRYGFTLKYDGTKNGSLTRHNMFAATSCPGKYLQNKFQELADTVNAKLSGSTTASSSTSSSKKSNETIAEEVIQGKWGNGDDRKNRLIAAGYDYNAIQKIVNQKLGATSSSSSSNKKSNETIANEVIQGKWGNGDDRKNRLTAAGYDYNAIQKIVNQKLGATSSSTSSNKKSNETIANEVIQGKWGNGTDRKNRLTAAGYDYNAIQKIVNQKLK

SEQ ID NO: 2932 - protein, 301 aa, unidentified
  REGION 1..301: note = Limosilactobacillus fermentum
MTTFKGIDVSQWQGNINFNAVKASGIDFVIIRAGYGHSTSQKDPYFEQNYTQAKNAGLNVGAYWYSYADSANDAKVEADTCLSVIAGKQFDYPIYFDLEERSQFNRGSNFCSALVSAFCSEIEDHGYYAGLYISRLPLQTYISSDIANRYALWIAEYNSRLNYGGEYGIWQYSSTGSISGISGNVDMDYSYIDYPAIIKQKGLNGYGTNTKSLKSTDEIVKEVLAGQWGNGDERKNRLTTAGYNYDAIQSAINQQLNTKSVDEIAREVIQGKWGNDPQRSQNLRAAGYDPATIQKRVNQLL

SEQ ID NO: 2933 - protein, 301 aa, unidentified
  REGION 1..301: note = Limosilactobacillus fermentum
MTTFKGIDVSQWQGNINFNAVKASGIDFVIIRAGYGHSTSQKDPYFEQNYTQAKNAGLNIGAYWYSYANSANDAKTEADTCLSVIAGKQFDYPIYFDLEERSQFNRGSSFCSALVTTFCSEIEAHGYYAGLYNSRSPLQTYISSDVANRYALWIAEYNSQLNYGGEYGIWQYSSAGTVSGISENVDMDYSYIDYPAIIKQKGLNGYGTNTKSLKSTDEIVKEVLAGQWGNGDERKNRLTTAGYNYDAIQAIINQQLNTKSVDDIAREVIQGKWGNDSQRSQNLRAAGYDPATIQKRVNQLL

SEQ ID NO: 2934 - protein, 283 aa, unidentified
  REGION 1..283: note = uncultured Methanobrevibacter sp.
MKSTEFVAMAKKIATDYKTLYVMGCFGSPMTAKNKQRFTQNHSYNKKSNRTKIIKAASASTFGFDCVCLVKSILWGWNGNSKNTYGGAVYKSNNVPDVSADDMMQYCTDVTTDFKNIQVGEILHMSGHVGIYIGDGLAVECTPIWKDGVQITAVGNLGNKSGYNTRTWVNHGKSKFIDYVAEKDSLDNYTDEQLADMAMKGVFGSGSERKTKLGDRYEAVQKIINQKTSSAINNQKLYHKVVKGDTLSKIAKKYNTSVSNIMKINSSIKDANMICLGQLIRVK

SEQ ID NO: 2935 - protein, 56 aa, Solobacterium sp.
MAPKPAAAPAAGKTLEEVAKEVIQGKWGNGQERKDKLTAAGYDYNTVQAKVNELLK

SEQ ID NO: 2936 - protein, 512 aa, unidentified
  REGION 1..512: note = Anaerosporobacter faecicola
MKLVESILTKNPCYTAGRKIEVKGLMLHSVGCSQPSALAFIKNWNSPSFDRACVHGFIDGNDGTVYQTLPWNHRGWHCGSSINGSANNTHIGVEMCEPSCITYVGGATFKCSDIATAKAVAERTYKAAVELFAMLCKKFSLDPLADGVIISHKEGHSRGIASNHGDPEHLWSQLGMGYTMDTFRKAVKSAMSDSENKKEGTQAAVFAGLSEKDAVSVIGELCREDMKKSGILASISAAQFILESGYGKSELGQNANNMFGMKKSLSGNTWTGSTWDGTSVYTKKTQEQNADGSYETITADFRKYSCVEDSVADHSAYLLGAKNGRSLRYKGIKGMTDYKKVAQLIKDGGYATSLTYVDKLCSIIEKWNLTQYDVLETQEPVPSTPDTVTEFPATPFTVKVLIDDLNYRSEPSMNGAVKGQTGKGVFTIVEVNDGWGRLKSGAGWIWLENPSYCTVQGTVTETPKTSSTKSVDEIAKEVIRGDWGNGEERKKKLTAAEYDYSVIQKKVNEILK

SEQ ID NO: 2937 - protein, 98 aa, unidentified
  REGION 1..98: note = Limosilactobacillus fermentum
MYDGTNTKSLKSTDEIVKEVMAGQWGNGDERKNRLTTAGYNYDAIQATINQQLNTKSVDDIAREVIQGKWGNDPQRSQKLRAAGYDPATIQKHVNQLL

SEQ ID NO: 2938 - protein, 93 aa, unidentified
  REGION 1..93: note = Clostridiales bacterium
MVKSGALYKVQVGAYSVKANATNMLNTLKKAGFSGYVTTSTGTAVAISSLKSVDEIAREVINGKWGNGSARKKKLTAAGYDYATIQKRVNELC

SEQ ID NO: 2939 - protein, 161 aa, synthetic construct
XNXPXXRXVIHXTCPDXGXPXASXAGRAXSTAXYFXXXXRXXSAHYXXDXXXTXQCLXEXXXGXHAPPNXXSIGIEICXXGGSXXSFXXXXHXYXXXQWLSXXVWPAVERAAXLARXICXRXXIPXRXLXXXXVXXGXXGICGHXXVSXAFXXSDHDDPGX

SEQ ID NO: 2940 - protein, 21 aa, synthetic construct
  VARIANT 6: note = I or L
  VARIANT 12: note = N or S
  VARIANT 17: note = K or R
LAXXVXXGXXGXGXXRXXXLG

SEQ ID NO: 2941 - protein, 19 aa, synthetic construct
  VARIANT 5: note = I or L
  VARIANT 11: note = N or S
  VARIANT 16: note = K or R
AXXVXXGXXGXGXXRXXXL

SEQ ID NO: 2942 - protein, 243 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVTSPNIDALADAVIRGEYGNGEERRRRLGANYAAVQKRVNEKLTG

SEQ ID NO: 2943 - protein, 243 aa, synthetic construct
MTFIQARHHGGNSNTPITRLVIHATCPDVGYPSASKAGRAVSTAEYFASTSRSASAHYVCDVSATVQCLSEETIGYHAPPNSHSIGIEICADGGSRASFEKASHAYTREQWLSPQVWPAVERAAILARGICHRHHIPVRKLTTAQVKSGMSGICGHDNVSDAFHQSDHDDPGPYFPWNEFIAAIQGKNTNKGELSMSDVTSPNIDALADAVIRGDYGNGEERRRRLGNLYDQVQARVNQKLGY

The invention claimed is:

1. A chimeric cell wall hydrolase (CWH) comprising the fusion of:
   a) a CLC1-family enzymatically active domain (EAD), said EAD having at least 95% sequence identity to SEQ ID NO: 2939; and
   b) a heterologous cell well binding domain (CBD), wherein the chimeric CWH exhibits lytic activity against Cutibacterium acnes.

2. The chimeric CWH of claim 1, wherein the EAD comprises SEQ ID NO: 2939.

3. The chimeric CWH of claim 1, wherein the EAD has at least 90% sequence identity to SEQ ID NO: 35.

4. The chimeric CWH of claim 1, wherein the EAD comprises SEQ ID NO: 35.

5. The chimeric CWH of claim 1, wherein the EAD has at least 90% sequence identity to SEQ ID NO: 20.

6. The chimeric CWH of claim 1, wherein the EAD comprises SEQ ID NO: 20.

7. The chimeric CWH of claim 1, wherein the EAD has a C-terminal truncation compared to any one of SEQ ID NO: 1-19.

8. The chimeric CWH of claim 7, wherein the chimeric CWH exhibits the lytic activity across a pH range of pH 4.2-8.0.

9. The chimeric CWH of claim 7, wherein the chimeric CWH exhibits peak lytic activity at a pH of about pH 5.5-6.5.

10. The chimeric CWH of claim 7, wherein the chimeric CWH retains at least 50% of its activity at 25° C. after being exposed to a temperature of up to 50° C. for 30 minutes.

11. The chimeric CWH of claim 7, wherein the chimeric CWH retains at least 50% of its activity at 25° C. after being exposed to a temperature of up to 75° C. for 30 minutes.

12. The chimeric CWH of claim 1, wherein the chimeric CWH exhibits minimal or no lytic activity against Corynebacterium xerosis, Corynebacterium striatum, and/or Staphylococcus epidermidis.

13. The chimeric CWH of claim 1, wherein the heterologous CBD comprises a sequence selected from the group consisting of SEQ ID NO: 2941, SEQ ID NO: 2940, SEQ ID NO: 47, and SEQ ID NO: 42.

14. The chimeric CWH of claim 1, wherein the CBD has at least 90% sequence identity to SEQ ID NO: 42.

15. The chimeric CWH of claim 1, wherein the CBD comprises SEQ ID NO: 42.

16. A topical formulation comprising the chimeric CWH according to claim 1.

17. The formulation of claim 16, wherein the formulation is a hydrogel.

18. The formulation of claim 16, wherein the formulation comprises 5-20 μg/mL of the chimeric CWH.

19. The formulation of claim 16, wherein the formulation comprises 1-5% w/v of a cellulose polymer selected from the group consisting of: hydroxyethyl cellulose, methylcellulose, hydroxypropyl methyl cellulose, carboxymethyl cellulose, microcrystalline cellulose, ethyl cellulose, sodium carboxymethyl cellulose, hydroxypropyl cellulose, and cellulose acetate.

20. The topical formulation of claim 16, which is comprised in a microneedle patch or a colloidal patch.

21. The topical formulation of claim 16, comprising a humectant selected from the list consisting of: aloe vera, betaine, butylene glycol, caprylyl glycol, dimethicone, fructose, glucomannan, glucose, glycerin, glyceryl glucoside, honey, hyaluronic acid, lactic acid, panthenol, polyethylene glycol, propylene glycol, propanediol, sodium hyaluronate, sodium lactate, sodium pyrrolidone carboxylic acid, sorbitol, and urea.

22. The topical formulation of claim 16, comprising betaine.

23. A method of treating a skin condition associated with *Cutibacterium acnes*, the method comprising applying the chimeric CWH of claim 1 to the skin.

24. The method of claim 23, wherein the skin condition is Acne vulgaris (acne), *C. acnes* infection, or is associated with overabundance of *C. acnes*.

25. The method of claim 23, wherein the method reduces number of acne lesions, severity of acne lesions, size of acne lesions, skin redness and/or pain.

* * * * *